(12) United States Patent
Alevizopoulos

(10) Patent No.: US 11,078,497 B2
(45) Date of Patent: Aug. 3, 2021

(54) COMPOSITIONS AND METHODS TO MANUFACTURE TUMOR SUPPRESSOR FUSIONS

(71) Applicant: TheraPten Biosciences Inc., Kelowna (CA)

(72) Inventor: Athanasios Alevizopoulos, Yverdon-les-Bains (CH)

(73) Assignee: THERAPTEN BIOSCIENCES INC., Kelowna (CA)

( * ) Notice: Subject to any disclaimer, the term of this patent is extended or adjusted under 35 U.S.C. 154(b) by 0 days.

(21) Appl. No.: 17/039,468

(22) Filed: Sep. 30, 2020

(65) Prior Publication Data
US 2021/0079423 A1 Mar. 18, 2021

Related U.S. Application Data

(63) Continuation of application No. PCT/IB2020/053458, filed on Apr. 11, 2020.

(60) Provisional application No. 62/833,251, filed on Apr. 12, 2019.

(51) Int. Cl.
*C12N 15/86* (2006.01)
*C07K 14/765* (2006.01)

(52) U.S. Cl.
CPC ............ *C12N 15/86* (2013.01); *C07K 14/765* (2013.01); *C07K 2319/00* (2013.01)

(58) Field of Classification Search
None
See application file for complete search history.

(56) References Cited

U.S. PATENT DOCUMENTS

| | | |
|---|---|---|
| 8,637,315 B2 | 1/2014 | Durocher et al. |
| 9,017,981 B2 | 4/2015 | Parsons |
| 10,053,498 B2 | 8/2018 | Li et al. |
| 2005/0130896 A1 | 6/2005 | Wooten |
| 2011/0135596 A1 | 6/2011 | Lee et al. |

FOREIGN PATENT DOCUMENTS

| | | |
|---|---|---|
| EP | 2 559 441 A2 | 2/2013 |
| WO | WO-99/42472 A1 | 8/1999 |
| WO | WO-2018/023114 A1 | 2/2018 |

OTHER PUBLICATIONS

Altinoglu et al, 2016: PMID: 27748775. Intracellular delivery of the PTEN protein using cationic lipidoids for cancer therapy. Biomater Sci. Nov. 15, 2016;4(12):1773-1780.
Chen & Eng, 2019: PMID: 30928438. PTEN Mutations Trigger Resistance to Immunotherapy. Trends Mol Med. Jun. 2019;25(6):461-463. doi: 10.1016/j.molmed.2019.03.003. Epub Mar. 27, 2019.
Feng & Tsao, 2016: PMID: 27699004. Emerging role of microRNA-21 in cancer. Biomed Rep. Oct. 2016;5(4):395-402. Epub Aug. 26, 2016.
Foreign Search Report and Written Opinion on PCT PCT/IB2020/053458 dated Jun. 30, 2020.
Hopkins et al, 2013: PMID: 23744781; A secreted PTEN phosphatase that enters cells to alter signaling and survival. Science. Jun. 26, 2013;341(6144):399-402. doi: 10.1126/science.1234907. Epub Jun. 6, 2013.
Horita et al. Nuclear PTEN functions as an essential regulator of SRF-dependent transcription to control smooth muscle differentiation. Nat Commun. Mar. 4, 2016;7:10830.
Li C et al, 2018: PMID: 29316891. Serum miR-486-5p as a diagnostic marker in cervical cancer: with investigation of potential mechanisms.BMC Cancer. Jan. 9, 2018;18(1):61. doi: 10.1186/s12885-017-3753-z.
Li Y et al, 2018 : PMID: 29704427. Cancer/testis antigen-Plac1 promotes invasion and metastasis of breast cancer through Furin/NICD/PTEN signaling pathway. Mol Oncol. Aug. 2018;12(8):1233-1248. doi: 10.1002/1878-0261.12311. Epub Jun. 14, 2018.
Liang et al, 2014 : PMID: 24768297. PTENα, a PTEN isoform translated through alternative initiation, regulates mitochondrial function and energy metabolism. Cell Metab. May 6, 2014;19(5):836-48. doi: 10.1016/j.cmet.2014.03.023. Epub Apr. 24, 2014.
Liang et al, 2017: PMID: 28332494. PTENβ is an alternatively translated isoform of PTEN that regulates rDNA transcription. Nat Commun. Mar. 23, 2017;8:14771. doi: 10.1038/ncomms14771.
Malaney et al, 2013: PMID: 24056727. The PTEN Long N-tail is intrinsically disordered: increased viability for PTEN therapy.Mol Biosyst. Nov. 2013;9(11):2877-88. doi: 10.1039/c3mb70267g.
Malaney et al, 2017: PMID: 28289760. PTEN proteoforms in biology and disease. Cell Mol Life Sci. Aug. 2017;74(15):2783-2794. doi: 10.1007/s00018-017-2500-6. Epub Mar. 13, 2017.
Masson et al, 2016: PMID: 26527737. The intrinsically disordered tails of PTEN and PTEN-L have distinct roles in regulating substrate specificity and membrane activity. Biochem J. Jan. 15, 2016;473(2):135-44. doi: 10.1042/BJ20150931. Epub Nov. 2, 2015.
Meuillet et al, 2004: PMID: 15313215. Thioredoxin-1 binds to the C2 domain of PTEN inhibiting PTEN's lipid phosphatase activity and membrane binding: a mechanism for the functional loss of PTEN's tumor suppressor activity. Arch Biochem Biophys. Sep. 15, 2004;429(2):123-33.
Mingo et al, 2019: PMID: 30993208. Precise definition of PTEN C-terminal epitopes and its implications in clinical oncology.NPJ Precis Oncol. Apr. 15, 2019;3:11. doi: 10.1038/s41698-019-0083-4. eCollection 2019.

(Continued)

*Primary Examiner* — John D Ulm
(74) *Attorney, Agent, or Firm* — Foley & Lardner LLP

(57) ABSTRACT

Provided herein is a fusion protein comprising, or alternatively consisting essentially of, or yet further consisting of an optional signal peptide, a serum albumin, an optional linker, a Phosphatase and Tensin Homolog (PTEN), and an optional purification or detectable marker in any order. Relating polynucleotides, vectors, host cells, pharmaceutical compositions and kits are also disclosed. Further provided are methods for delivering a fusion protein to a subject, treating a cancer or tumor, and/or producing the fusion protein.

29 Claims, 54 Drawing Sheets
Specification includes a Sequence Listing.

(56) References Cited

OTHER PUBLICATIONS

Moulton et al. PTEN deficiency promotes pathological vascular remodeling of human coronary arteries. JCI Insight . Feb. 22, 2018;3(4):e97228.

Odriozola et al, 2007: PMID: 17565999. Regulation of PTEN activity by its carboxyl-terminal autoinhibitory domain.J Biol Chem. Aug. 10, 2007;282(32):23306-15. Epub Jun. 12, 2007.

Pulido et al, 2014: PMID: 24985344. A unified nomenclature and amino acid numbering for human PTEN. Sci Signal. Jul. 1, 2014;7(332):pe15. doi: 10.1126/scisignal.2005560.

Pulido et al, 2019: PMID: 31501265. Precise Immunodetection of PTEN Protein in Human Neoplasia.Cold Spring Harb Perspect Med. Dec. 2, 2019;9(12). pii: a036293. doi: 10.1101/cshperspect. a036293.

Rulle et al, 2018: PMID: 30240851. Computer-Based Intensity Measurement Assists Pathologists in Scoring Phosphatase and Tensin Homolog Immunohistochemistry—Clinical Associations in NSCLC Patients of the European Thoracic Oncology Platform Lungscape Cohort.J Thorac Oncol. Dec. 2018;13(12):1851-1863. doi: 10.1016/j.jtho.2018.08.2034. Epub Sep. 18, 2018.

Russell et al, 2018:PMID: 30479334. PTEN expression by an oncolytic herpesvirus directs T-cell mediated tumor clearance. Nat Commun. Nov. 27, 2018;9(1):5006. doi: 10.1038/s41467-018-07344-1.

Ryu et al, 2020: PMID: 32057052.Modular protein-DNA hybrid nanostructures as a drug delivery platform.Nanoscale. Feb. 14, 2020. doi: 10.1039/c9nr08519j. [Epub ahead of print].

Sand et al, 2015 : PMID: 25674083. Unraveling the Interaction between FcRn and Albumin: Opportunities for Design of Albumin-Based Therapeutics.Front Immunol. Jan. 26, 2015;5:682. doi: 10.3389/fimmu.2014.00682. eCollection 2014.

Sangale et al, 2011 : PMID : 20930614. A robust immunohistochemical assay for detecting PTEN expression in human tumors.Appl Immunohistochem Mol Morphol. Mar. 2011;19(2):173-83. doi: 10.1097/PAI.0b013e3181f1da13.

Schmidt et al, 2017: PMID: 28637874. Direct demonstration of a neonatal Fc receptor (FcRn)-driven endosomal sorting pathway for cellular recycling of albumin. J Biol Chem. Aug. 11, 2017;292(32):13312-13322. doi: 10.1074/jbc.M117.794248. Epub Jun. 21, 2017.

Spinelli & Leslie, 2015: PMID: 25461809. Assaying PTEN catalysis in vitro. Methods. May 2015;77-78:51-7. doi: 10.1016/j.ymeth. 2014.11.003. Epub Nov. 13, 2014.

Strohl Wr, 2015:PMID: 26177629. Fusion Proteins for Half-Life Extension of Biologics as a Strategy to Make Biobetters. BioDrugs. Aug. 2015;29(4):215-39. doi: 10.1007/s40259-015-0133-6.

Swiercz et al, 2017: PMID: 27974681. Loss of expression of the recycling receptor, FcRn, promotes tumor cell growth by increasing albumin consumption. Oncotarget. Jan. 10, 2017;8(2):3528-3541. doi: 10.18632/oncotarget.13869.

Tzani et al, 2016: PMID: 27249819. Systematic analysis of the PTEN 5' leader identifies a major AUU initiated proteoform. Open Biol. May 2016;6(5). pii: 150203. doi: 10.1098/rsob.150203. Epub May 25, 2016.

Wu et al, 2017: PMID: 28783500. Treatment with PTEN-Long protein inhibits hepatitis C virus replication. Virology. Nov. 2017;511:1-8. doi: 10.1016/j.virol.2017.08.002. Epub Aug. 4, 2017.

Zhao et al, 2013: PMID: 23951172. In vivo monitoring of angiogenesis inhibition via down-regulation of mir-21 in a VEGFR2-luc murine breast cancer model using bioluminescent imaging.PLoS One. Aug. 8, 2013;8(8):e71472. doi: 10.1371/journal.pone.0071472. eCollection 2013.

Zhu et al, 2015: PMID: 26078940. Molecular Analysis of AFP and HSA Interactions with PTEN Protein.Biomed Res Int. 2015;2015:256916. doi: 10.1155/2015/256916. Epub May 20, 2015.

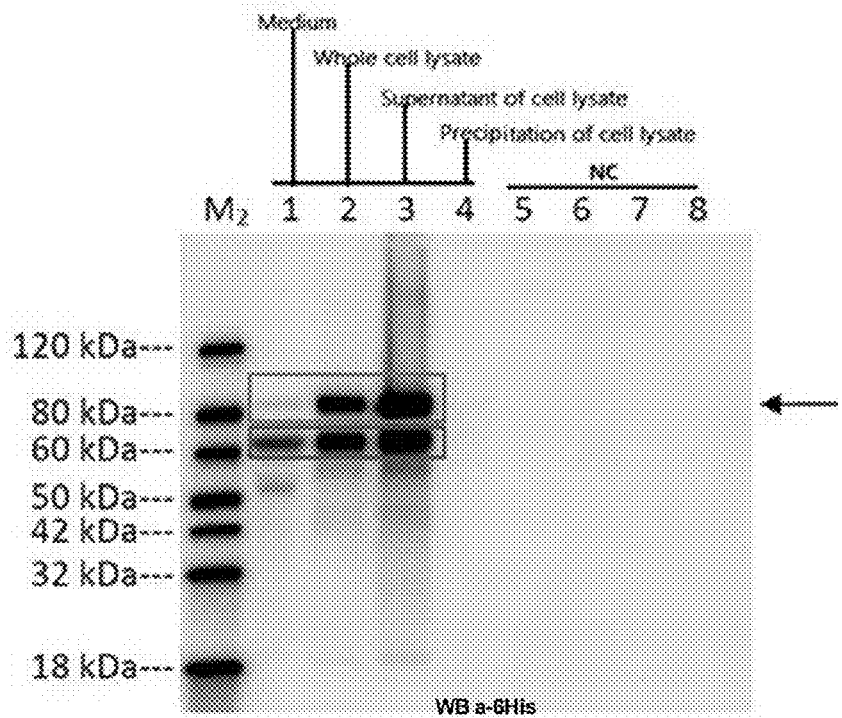

FIG. 5A

MVSAIVLYVLLAAAAHSAFASDKIIHLTDDSFDTDVLKADGAILVDFWAHWCGPCK
MIAPILDEIADEYQGKLTVAKLNIDHNPGTAPKYGIRGIPTLLLFKNGEVAATKVGAL
SKGQLKEFLDANLAENLYFQGISRAGNAGELVSPLLLPPTRRRRRRHIQGPGPVLNLP
SAAAAPPVARAPEAAGGGSRSEDYSSSPHSAAAAARPLAAEEKQAQSLQPSSSRRSS
HYPAAVQSQAAAERGASATAKSRAISILQKKPRHQQLLPSLSSFFFSHRLPDMTAIIKE
IVSRNKRRYQEDGFDLDLTYIYPNIIAMGFPAERLEGVYRNNIDDVVRFLDSKHKNHY
KIYNLCAERHYDTAKFNCRVAQYPFEDHNPPQLELIKPFCEDLDQWLSEDDNHVAAI
HCKAGKGRTGVMICAYLLHRGKFLKAQEALDFYGEVRTRDKKGVTIPSQRRYVYYY
SYLLKNHLDYRPVALLFHKMMFETIPMFSGGTCNPQFVVCQLKVKIYSSNSGPTRRE
DKFMYFEFPQPLPVCGDIKVEFFHKQNKMLKKDKMFHFWVNTFFIPGPEETSEKVEN
GSLCDQEIDSICSIERADNDKEYLVLTLTKNDLDKANKDKANRYFSPNFKVKLYFTKT
VEEPSNPEASSSTSVTPDVSDNEPDHYRYSDTTDSDPENEPFDEDQHTQITKVHHHHH
H

FIG. 5B

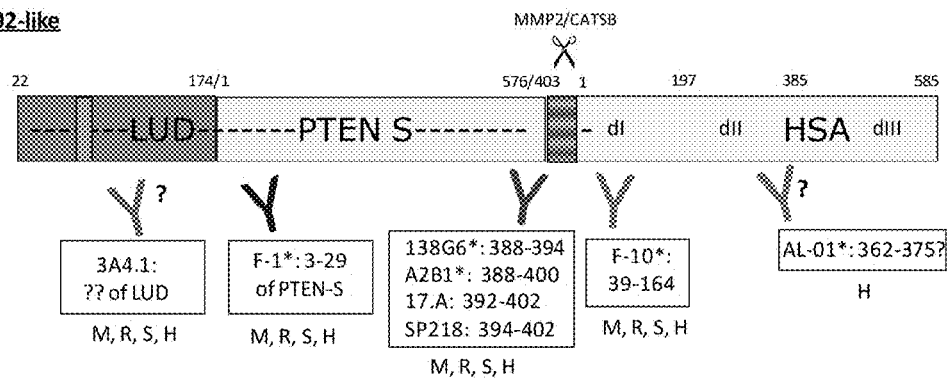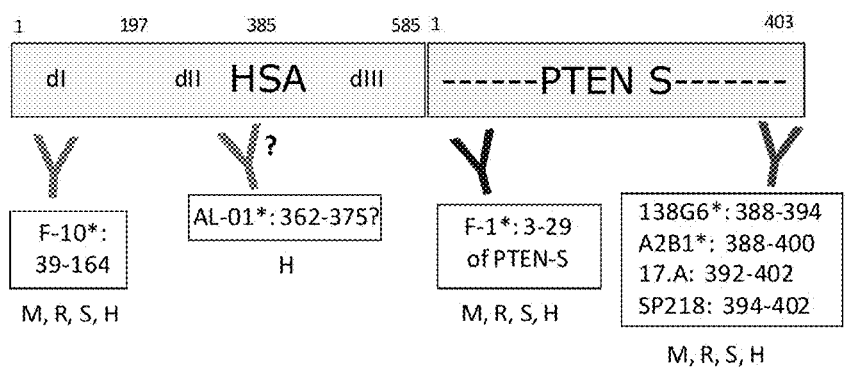
FIG. 6B

47upF (SEQ ID NO:212)

AAAAGAATTCGAT$^{143675}$TGGGTTCGATTGGCAATGTTGTCTC$^{143699}$

47upR (SEQ ID NO:213)

AAAAACTAGTGAT$^{145310}$GTCCCGGGTACGACCATCACCCGAG$^{145286}$

47dnF (SEQ ID NO:214)

AAAAAAGCTT$^{145570}$CACGACATGCTCCCCCCGACGAGC$^{145594}$

47dnR (SEQ ID NO:215)

AAAACAGCTG$^{146980}$ACGCGGAACTAGCGCGGACCGGTCG$^{146956}$

345upF (SEQ ID NO:218)

$^{151458}$CTCTGACCTGAGATTGGCGGCACTG$^{151482}$

345upR (SEQ ID NO:219)

GCGGCCGCAGCGCTGCGGCCGC$^{644}$CGCGGGCGCGCTCCTGACCGCGGG$^{621}$

345dnF (SEQ ID NO:220)

GCGGCCGCAGCGCTGCGGCCGC$^{1426}$CAGCGCGGCGGGGCCCGGCCAACCA$^{1450}$

345dnR (SEQ ID NO:221)

$^{2895}$TTCTTCCCTCTTCTCCCGCCCTCCA$^{2871}$

FIG. 6E

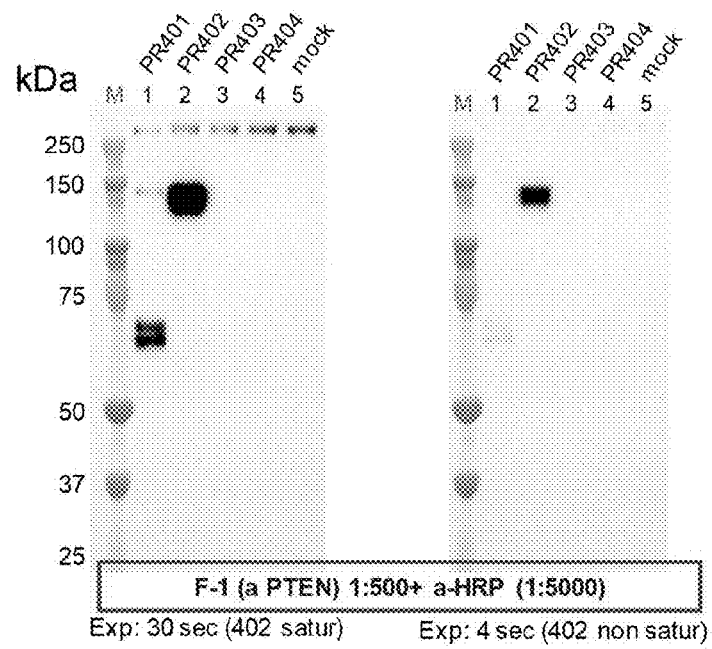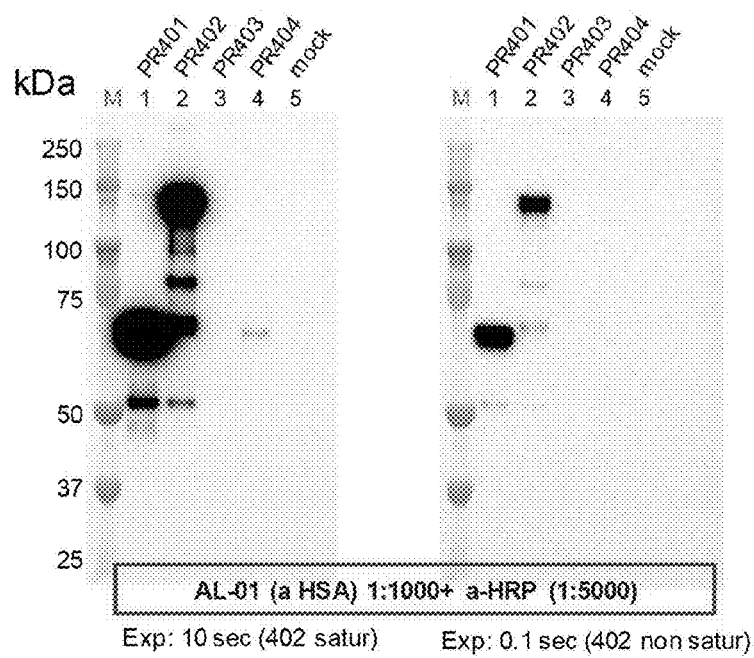
FIG. 10A

MKWVTFISLLFLFSSAYSRGVFRRDAHKSEVAHRFKDLGEENFKALVLIAFAQYLQQCPFEDH

VKLVNEVTEFAKTCVADESAENCDKSLHTLFGDKLCTVATLRETYGEMADCCAKQEPERNEC

FLQHKDDNPNLPRLVRPEVDVMCTAFHDNEETFLKKYLYEIARRHPYFYAPELLFFAKRYKA

AFTECCQAADKAACLLPKLDELRDEGKASSAKQRLKCASLQKFGERAFKAWAVARLSQRFPK

AEFAEVSKLVTDLTKVHTECCHGDLLECADDRADLAKYICENQDSISSKLKECCEKPLLEKSH

CIAEVENDEMPADLPSLAADFVESKDVCKNYAEAKDVFLGMFLYEYARRHPDYSVVLLLRLA

KTYETTLEKCCAAADPHECYAKVFDEFKPLVEEPQNLIKQNCELFEQLGEYKFQNALLVRYTK

KVPQVSTPTLVEVSRNLGKVGSKCCKHPEAKRMPCAEDYLSVVLNQLCVLHEKTPVSDRVTK

CCTESLVNRRPCFSALEVDETYVPKEFNAETFTFHADICTLSEKERQIKKQTALVELVKHKPKA

TKEQLKAVMDDFAAFVEKCCKADDKETCFAEEGKKLVAASQAALGLTNRRKKRALDAAYIS

RAGNAGELVSPLLLPPTRRRRRRHIQGPGPVLNLPSAAAAPPVARAPEAAGGGSRSEDYSSSPH

SAAAAARPLAAEEKQAQSLQPSSSRRSSHYPAAVQSQAAAERGASATAKSRAISILQKKPRHQ

QLLPSLSSFFFSHRLPDMTAIIKEIVSRNKRRYQEDGFDLDLTYIYPNIIAMGFPAERLEGVYRN

NIDDVVRFLDSKHKNHYKIYNLCAERHYDTAKFNCRVAQYPFEDHNPPQLELIKPFCEDLDQ

WLSEDDNHVAAIHCKAGKGRTGVMICAYLLHRGKFLKAQEALDFYGEVRTRDKKGVTIPSQ

RRYVYYYSYLLKNHLDYRPVALLFHKMMFETIPMFSGGTCNPQFVVCQLKVKIYSSNSGPTR

REDKFMYFEFPQPLPVCGDIKVEFFHKQNKMLKKDKMFHFWVNTFFIPGPEETSEKVENGSLC

DQEIDSICSIERADNDKEYLVLTLTKNDLDKANKDKANRYFSPNFKVKLYFTKTVEEPSNPEAS

SSTSVTPDVSDNEPDHYRYSDTTDSDPENEPFDEDQHTQITKVHHHHHH

FIG. 11C

MKWVTFISLLFLFSSAYSRGVFRRSESPVTISRAGNAGELVSPLLLPPTRRRRRRRHIQGPGPVLN
LPSAAAAPPVARAPEAAGGGSRSEDYSSSPHSAAAAARPLAAEEKQAQSLQPSSSRRSSHYPA
AVQSQAAAERGASATAKSRAISILQKKPRHQQLLPSLSSFFFSHRLPDMTAIIKEIVSRNKRRYQ
EDGFDLDLTYIYPNHAMGFPAERLEGVYRNNIDDVVRFLDSKHKNHYKIYNLCAERHYDTAK
FNCRVAQYPFEDHNPPQLELIKPFCEDLDQWLSEDDNHVAAIHCKAGKGRTGVMICAYLLHR
GKFLKAQEALDFYGEVRTRDKKGVTIPSQRRYVYYYSYLLKNHLDYRPVALLFHKMMFETIP
MFSGGTCNPQFVVCQLKVKIYSSNSGPTRREDKFMYFEFPQPLPVCGDIKVEFFHKQNKMLKK
DKMFHFWVNTFFIPGPEETSEKVENGSLCDQEIDSICSIERADNDKEYLVLTLTKNDLDKANKD
KANRYFSPNFKVKLYFTKTVEEPSNPEASSSTSVTPDVSDNEPDHYRYSDTTDSDPENEPFDED
QHTQITKVDAHKSEVAHRFKDLGEENFKALVLIAFAQYLQQCPFEDHVKLVNEVTEFAKTCV
ADESAENCDKSLHTLFGDKLCTVATLRETYGEMADCCAKQEPERNECFLQHKDDNPNLPRLV
RPEVDVMCTAFHDNEETFLKKYLYEIARRHPYFYAPELLFFAKRYKAAFTECCQAADKAACL
LPKLDELRDEGKASSAKQRLKCASLQKFGERAFKAWAVARLSQRFPKAEFAEVSKLVTDLTK
VHTECCHGDLLECADDRADLAKYICENQDSISSKLKECCEKPLLEKSHCIAEVENDEMPADLP
SLAADFVESKDVCKNYAEAKDVFLGMFLYEYARRHPDYSVVLLLRLAKTYETTLEKCCAAA
DPHECYAKVFDEFKPLVEEPQNLIKQNCELFEQLGEYKFQNALLVRYTKKVPQVSTPTLVEVS
RNLGKVGSKCCKHPEAKRMPCAEDYLSVVLNQLCVLHEKTPVSDRVTKCCTESLVNRRPCFS
ALEVDETYVPKEFNAETFTFHADICTLSEKERQIKKQTALVELVKHKPKATKEQLKAVMDDFA
AFVEKCCKADDKETCFAEEGKKLVAASQAALGLHHHHHH

FIG. 19A

| Residue (numbering after SEQ ID NO:1) | PR402 LUD O-glycan | F137 LUD O-glycan | LUD of Sf9-expressed PTEN-M (Fig. 5) | Comment |
|---|---|---|---|---|
| S65 | sT | mixed (Tn, sT, 2sT) | GlcNAc | |
| S85 | sT | sT, 2ST | | mutated in Cys in the mouse |
| S89 | | sT, 2ST | | |
| S91 | | | GlcNAc | |
| S94 | | sT | | |
| S111 | | 2sT | | |
| S115 | 2sT | | | |
| S117 | sT | sT | | |
| S129 | sT | sT, 2ST | | mutated in Gly in the mouse |
| S134 | | | GlcNAc | |
| T140 | sT | sT, 2ST | | Cancer mutation (T140A) |
| S161 | 2sT | mixed (Tn, sT, 2sT) | | Membrane Binding Domain (SEQ ID NO:40): several cancer-related mutations are found in this region |
| S163 | | Tn | | |
| S164 | sT | mixed (Tn, sT, 2sT) | | |
| S168 | sT | sT, 2ST | | |

FIG. 19B

22
SESPVTISRAGMAGELVSPLLLPPTRRRRRHQGPGPVTLNLPSAAAAPPVARAPEAAGGSSREDYSSSPHSAAAAARPLAAEEKQ

SESPVTISRAGMAGELVSPLLLPPTRRRRRHQGPGPVTLNLPSAAAAPPVARAPEAAGGSSREDYSSPHSAAAAARPLAAEEKQ
                                                                  85    89  94

AQSLQPSSRSSHYPAAVQSAAAERGASAIAKSRAISTLQKKPRHQLLPSLSFFTSHRLPD
                                                161 164     168

AQSLQPSSRSSHYPAAVQSAAAERGASAIAKSRAISTLQKKPRHQLLPSLSFFTSHRLPD
111 115 117                    120           140

FIG. 19C

| Residue (numbering after SEQ ID NO:2) | Glycan type | Glycan structure | Comment |
|---|---|---|---|
| S170 | O-linked | sT | mutation eliminates phosphatase activity |
| N292 | N-linked | A2G1F, A2G2F, A2S1G1F, A2S2F | CHO-cell specific glycans |
| S355 | O-linked | Tn | |
| S360 | O-linked | Tn | |
| S366 | O-linked | sT | GSK3 phosphorylation site |
| S370 | O-linked | Tf | PLK3 phosphorylation site |

FIG. 19D

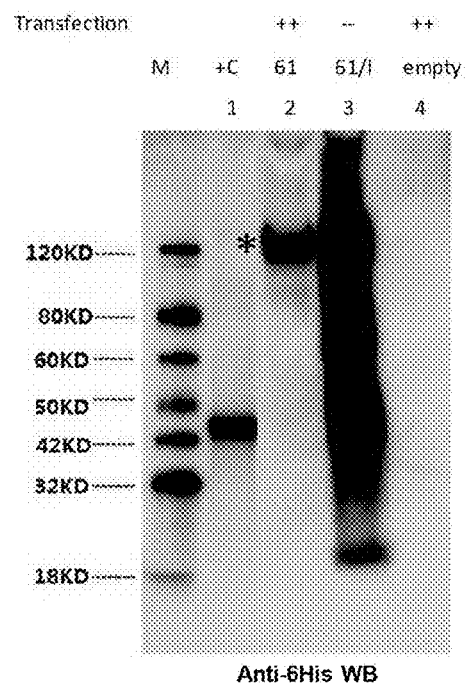
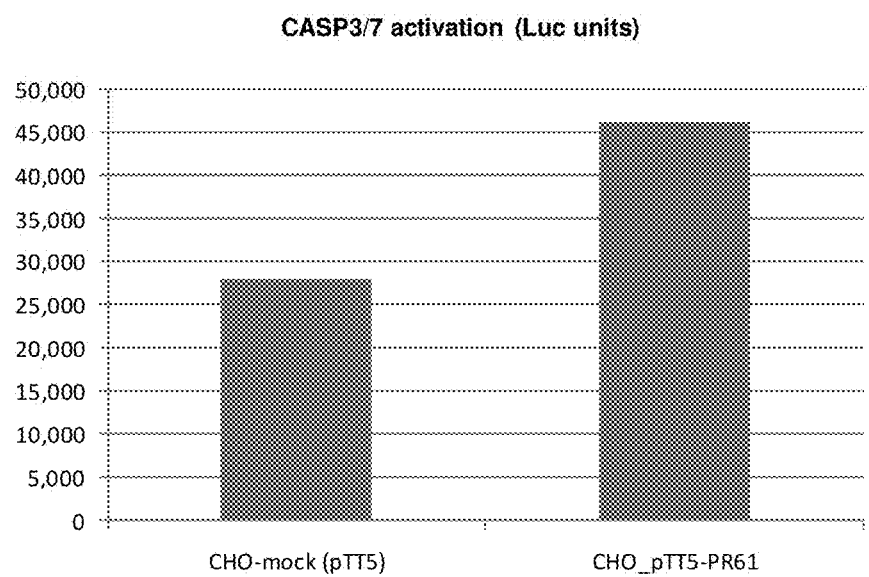
FIG. 20F

COMPOSITIONS AND METHODS TO MANUFACTURE TUMOR SUPPRESSOR FUSIONS

CROSS-REFERENCE TO RELATED APPLICATION

This application is a continuation application filed under 35 U.S.C. § 111(a) claiming the benefit under 35 U.S.C. §§ 120 and 365(c) of International Patent Application No. PCT/IB2020/053458, filed on Apr. 11, 2020, which is based upon and claims priority under 35 U.S.C. 119(e) to U.S. Provisional Application No. 62/833,251, filed Apr. 12, 2019, the contents of each of which are hereby incorporated by reference into the present disclosure.

SEQUENCE LISTING

The instant application contains a Sequence Listing which has been submitted electronically in ASCII format and is hereby incorporated by reference in its entirety. Said ASCII copy, created on Apr. 29, 2020, is named 117646-0141_SL.txt and is 989,906 bytes in size.

TECHNICAL FIELD

This disclosure relates to novel tumor suppressor fusion proteins and methods to manufacture these proteins.

BACKGROUND

The Phosphatase and Tensin homolog (PTEN) tumor suppressor was identified in 1997. PTEN is a protein phosphatase with a key mission to down-regulate the activity of the pi3K/AKT kinase pathway, which is very frequently over-activated in cancer. As such, PTEN is inactivated at the level of primary cancer, metastasis, cancer stem cells, and/or circulating tumor cells, across literally all solid cancers, lymphoma and leukemia and in about 25% of all cancer cases. Cancer patients may have complete loss of the PTEN protein ("PTEN null") or mutated cancer-promoting PTEN proteins that form homo- or hetero-dimers with any normal PTEN left in the cell. PTEN defects can be corrected by bypassing the cell membrane via transfection or viral infection of the PTEN gene or liposomal encapsulation of the protein. Release of active PTEN in the interior of the cells leads to strong anti-cancer responses (e.g., growth inhibition or death) of cells and xenografted tumors, concomitantly with down-regulation of pi3K pathway pharmacodynamic (PD) biomarkers (e.g., AKT, pPRAS40, pS6K). However, neither approach has had any therapeutic or commercial applicability, as evidenced by the lack of such patents and clinical trials. Thus, there exists a need to manufacture PTEN in soluble form and in high quantities to treat cancer and other diseases. This disclosure satisfies this need and provides related advantages as well.

SUMMARY OF THE DISCLOSURE

Disclosed are compositions comprising, or alternatively consisting essentially of, or yet further consisting of consecutive amino acids of a PTEN (which is also referred to herein as a PTEN tumor suppressor, for example a PTEN-L and/or a human PTEN) in fusion with consecutive amino acids of a serum albumin (for example a human serum albumin). Also disclosed are compositions comprising, or alternatively consisting essentially of, or yet further consisting of consecutive amino acids of the PTEN tumor suppressor in fusion with consecutive amino acids of human serum albumin. Also disclosed are methods to manufacture the compositions.

Thus, in one aspect, this disclosure provides a fusion protein comprising, or alternatively consisting essentially of, or yet further consisting of consecutive amino acid sequences of human serum albumin (HSA) and the human PTEN-L or PTEN tumor suppressor. In one aspect, the amino acid sequence of the serum albumin is conjugated directly or indirectly to the N-terminal of the PTEN. In another aspect, the amino acid sequence of the serum albumin is conjugated directly or indirectly to the C-terminal of the PTEN.

In one aspect, the PTEN is selected from the group of: human PTEN, simian PTEN, rat PTEN, or murine PTEN or a fragment, analogue, variant, mutant, isoform or equivalent of each. In one embodiment, the PTEN is a human PTEN or a fragment, analogue, variant, mutant, or equivalent thereof. In another embodiment, the PTEN is a murine (i.e., mouse) PTEN or a fragment, analogue, variant, mutant, or equivalent thereof. Additionally or alternatively, the PTEN is a PTEN-Long (PTEN-L), or a fragment, analogue, variant, mutant, or equivalent thereof. In another embodiment, the PTEN-L is a human PTEN-L comprising, or consisting essentially of, or consisting of an amino acid sequence of SEQ ID NO:3, or an equivalent thereof. Additionally or alternatively, the PTEN-L is a human PTEN-L encoded by an engineered polynucleotide sequence of SEQ ID NO:171, nucleotide (nt) 64-nt 1728 of SEQ ID NO:171, or a sequence at least 90% identical thereto which encodes the same amino acid sequence as encoded by SEQ ID NO:171 or nucleotide (nt) 64-nt 1728 of SEQ ID NO:171. In another embodiment, the PTEN is a PTEN-M isoform, or a fragment, analogue, variant, mutant, or equivalent thereof. The PTEN-M is a human PTEN-M having an amino acid sequence of SEQ ID NO:6. Additionally or alternatively, the PTEN-M is a human PTEN-M encoded by an engineered polynucleotide sequence of SEQ ID NO:198, or a sequence at least 90% identical thereto which encodes the same amino acid sequence as SEQ ID NO:6. In yet another embodiment, the PTEN is a PTEN-N isoform, or a fragment, analogue, variant, mutant, or equivalent thereof, optionally wherein the PTEN-N is a human PTEN-N having an amino acid sequence of SEQ ID NO:7, and/or optionally wherein the PTEN-N is a human PTEN-N encoded by an engineered polynucleotide sequence of SEQ ID NO:199, or a sequence at least 90% identical thereto which encodes the same amino acid sequence as SEQ ID NO:7. In a further embodiment, the PTEN is a PTEN-O isoform, or a fragment, analogue, variant, mutant, or equivalent thereof. The PTEN-O is a human PTEN-O having an amino acid sequence of SEQ ID NO:8. Additionally or alternatively, the PTEN-O is a human PTEN-O encoded by an engineered polynucleotide sequence of SEQ ID NO:200, or a sequence at least 90% identical thereto which encodes the same amino acid sequence as SEQ ID NO:8. In a further embodiment, the PTEN is a PTEN-S isoform, or a fragment, analogue, variant, mutant, or equivalent thereof. The PTEN-S is a human PTEN-S having an amino acid sequence of SEQ ID NO:2 or an equivalent thereof. Additionally or alternatively, the PTEN-S is a human PTEN-S encoded by an engineered polynucleotide sequence of SEQ ID NO:172, or a sequence at least 90% identical thereto which encodes the same amino acid sequence as SEQ ID NO:2. In yet a further embodiment, the PTEN comprises a minimal PTEN-S, or a fragment, analogue, variant, mutant, or equivalent thereof. The minimal PTEN-S comprises an amino acid sequence of SEQ ID NO:162. Additionally or alternatively, the minimal PTEN-S comprises an amino acid sequence encoded by the engineered polynucleotide sequence selected SEQ ID NO:197, or a sequence at least 90% identical thereto which encodes the same amino acid sequence as SEQ ID NO:162.

In one aspect, the PTEN comprises amino acids 174 to 576 of SEQ ID NO:1 and one or more of the following: amino acids 22-27 of SEQ ID NO:1; amino acids 44-59 of SEQ ID NO:1; amino acids 43-79 of SEQ ID NO:1; amino acids 80-120 of SEQ ID NO:1; amino acids 121-173 of SEQ ID NO:1; and/or amino acids 151-173 of SEQ ID NO:1. In one embodiment, the PTEN comprises amino acids 121-173 of SEQ ID NO:1. In a further embodiment, the PTEN comprises amino acids 121-173 of SEQ ID NO:1 and PTEN-S. In a further embodiment, the PTEN comprises an amino acid sequence of SEQ ID NO: 25. In another embodiment, the PTEN comprises an amino acid sequence of SEQ ID NO: 50.

In a further embodiment, the fusion protein comprises, or alternatively consists essentially of, or yet further consists of an amino acid sequence selected from the group of SEQ ID NOs: 28, 19, 18, 129 131, 25 or 50. In a further aspect the PTEN comprises, or consists essentially of, or yet further consists of the amino acid sequence of PR61 (SEQ ID NO: 19) or an equivalent thereof.

In one aspect, provided is a fusion protein comprising, or alternatively consisting essentially of, or yet further consisting of an amino acid sequence encoded by an engineered polynucleotide sequence selected from the group of: SEQ ID NOs: 54-70, 74-77, 135-160 or a fragment thereof, or a polynucleotide at least 90% identical thereto and which encodes the same amino acid sequence as SEQ ID NOs: 54-70, 74-77, 135-160, respectively. In one embodiment, the fusion protein comprises, or alternatively consists essentially of, or yet further consists of an amino acid sequence encoded by an engineered polynucleotide sequence selected from the group of: SEQ ID NOs: 68, 59, 58, 157, 159, 65, or 136, or a fragment thereof, or a sequence at least 90% identical thereto which encodes the same amino acid sequence as SEQ ID NOs: 68, 59, 58, 157, 159, 65, or 136, respectively.

In a further aspect, provided is a fusion protein comprising, or alternatively consisting essentially of, or yet further consisting of any one of the amino acid sequence of SEQ ID NOs: 14-17, 20-27, 29-30, 34-37, 49-50, 109-132, or a fragment, analogue, variant or equivalent of each, or a mutant of each. In a further embodiment, the fusion protein further comprises one or more mutations selected a position equivalent to any one or more of the following: S65, S85, S89, S91, S94, S111, S115, S117, S129, S134, T140, S161, S163, S164 and S168 of SEQ ID NO:1 and/or S170, N292, S355, S360, S366 and S370 of SEQ ID NO:2, optionally to an aspartate or a glutamate. Additionally or optionally, the protein is glycosylated. For example, one or more of the serine (S) and/or threonine (T) residues of the protein is O-glycosylated, and/or one or more of asparagine (N) residues of the protein is N-glycosylated. In one embodiment, the fusion protein comprises, or alternatively consists essentially of, or yet further consists of an amino acid sequence selected from the group of SEQ ID NOs: 28, 19, 18, 129, 131, 25 or 50, or a fragment, analogue, variant or equivalent of each thereof.

Optionally, the fusion protein further comprises one or more mutations selected a position equivalent to any one or more of the following: S65, S85, S89, S91, S94, S111, S115, S117, S129, S134, T140, S161, S163, S164 and S168 of SEQ ID NO:1 and/or S170, N292, S355, S360, S366 and S370 of SEQ ID NO:2 or an equivalent thereof that retains these mutated amino acids. In one embodiment, the amino acid(s) is/are mutated to an aspartate or a glutamate. In certain embodiments, the fusion protein further comprises one or more mutations selected a position equivalent to any one or more of the following: S115, S117, S129, S134, T140, S161, S163, S164 and S168 of SEQ ID NO: 1 or an equivalent thereof that retains these mutated amino acids. In a further embodiment, the fusion protein further comprises one or more mutations selected a position equivalent to any one or more of the following: S115, S117, S163, S164 and S168 of SEQ ID NO: 1 or an equivalent thereof that retains these mutated amino acids.

Additionally, the serum albumin is selected from the group of: a human serum albumin (HSA), a simian serum albumin (SSA), a rat serum albumin (RSA), or a mouse serum albumin (MSA), or a fragment, analogue, variant, mutant, isoform or equivalent of each. In one embodiment, the serum albumin is an HSA or a fragment, analogue, variant, mutant, isoform or equivalent thereof. In another embodiment, the serum albumin is a MSA or a fragment, analogue, variant, mutant, isoform or equivalent thereof. In one embodiment, the albumin comprises an amino acid sequence of amino acids 35-385 or 63-585 of SEQ ID NO:13 or an equivalent thereof. Optionally, the serum albumin comprises a mutation at a position equivalent to amino acid 58 or SEQ ID NO:12 (also known as amino acid 34 of SEQ ID NO:13) or an equivalent thereof that retains these mutated amino acids. Further optionally the mutation is from Cysteine to Serine. Additionally or alternatively, the serum albumin comprises an amino acid conjugated with a molecule at a position equivalent to amino acid 34 of SEQ ID NO:13 or an equivalent thereof that retains these mutated amino acids. The molecule is selected from the group of: a small molecule, a cytotoxic molecule, a linker, a pH-sensitive linker, and/or a thiol linker. In a further embodiment, the serum albumin comprises an amino acid sequence selected from the group of: SEQ ID NOs:12-13, 90-93 and 163, or a fragment, analogue, variant, mutant, isoform or an equivalent of any one of SEQ ID NOs:12-13, 90-93 and 163 that has the same or similar activity as SEQ ID NOs:12, 13, 90-93, or 163, respectively. In one embodiment, the serum albumin comprises an amino acid sequence of SEQ ID NO: 92, or a fragment, analogue, variant, mutant, isoform or an equivalent of SEQ ID NO: 92 that has the same or similar activity as SEQ ID NO: 92. In another embodiment, the serum albumin comprises an amino acid sequence of SEQ ID NO: 90, or a fragment, analogue, variant, mutant, isoform or an equivalent of SEQ ID NO: 90 that has the same or similar activity as SEQ ID NO: 90. In yet a further embodiment, the serum albumin comprises an amino acid sequence selected of SEQ ID NO:13, or a fragment, analogue, variant, mutant, isoform or an equivalent thereof that has the same or similar activity as SEQ ID NO: 13. One of such fragment comprises an amino acid sequence of SEQ ID NO: 163. Additionally or alternatively, the serum albumin comprises an amino acid sequence encoded by an engineered polynucleotide sequence selected from the group of: SEQ ID NO:176-179, or a sequence at least 90% identical thereto which encodes the same amino acid sequence as encoded by SEQ ID NO:176-179.

In a further aspect, the fusion protein further comprises a signal peptide. In one embodiment, the signal peptide is at the N-terminal of the fusion protein for secretion and/or is selected from the group of: an HSA signal peptide, an SSA signal peptide, an RSA signal peptide, an MSA signal peptide, a signal peptide of murine α2-macroglobulin, a murine fibrinogen signal peptide, a murine α1-antitrypsin signal peptide, a murine IgGκ chain signal peptide, a human IgG heavy chain signal peptide, a human CD33 signal peptide, or an artificial signal peptide. In a further embodiment, the signal peptide comprises an amino acid sequence selected from the group of SEQ ID NOs:93-105. In yet a further embodiment, the signal peptide comprises an amino acid sequence selected from the group of SEQ ID NOs: 93, 99, 100, 103, or 105. In one embodiment, the signal peptide comprises an amino acid sequence selected from the group of SEQ ID NOs: 93, 99, or 100. In certain embodiments, the signal peptide is encoded by an engineered polynucleotide sequence selected from the group of: SEQ ID NO:180-192, or a sequence at least 90% identical thereto which encodes the same amino acid sequence as SEQ ID NO:93-105, respectively.

In yet a further embodiment, the fusion protein further comprises one or more of the following: a first linker between the albumin and the PTEN, a second linker at the C-terminal of the signal peptide and a third linker at the N-terminal of the fusion protein. In one embodiment, one or more of the linkers are cleavable, optionally by a protease present in a peri-cancerous cell or tissue, or an intracellular protease. In a further embodiment, one or more of the linkers comprise an amino acid sequence selected from the group of SEQ ID NO:48 or 106-108.

In one aspect, the HSA comprises, or consists essentially of, or yet further consists of the amino acid sequence of SEQ ID NO:12 or SEQ ID NO:13, or SEQ ID NO:90-92, or SEQ ID NO:163 or an equivalent, a fragment, analogue or variant of each. In a further aspect, the PTEN or PTEN-L comprises, or consists essentially of, or yet further consists of, the amino acid sequence of SEQ ID NO:1, 2, 3, 6, 7, 8, 88 or 89, or SEQ ID NO:134 or SEQ ID NO:162, or an equivalent, a fragment, analogue or variant of each. In another aspect, a fusion protein comprises, or consists essentially of, or yet further consists of an amino acid sequence selected from the group of: SEQ ID NOs:28, 14-17, 18, 19, 20-27, 29-30, 50, 117-132 or a fragment, analogue, variant, mutant, or equivalent of each of SEQ ID NOs:28, 14-17, 18, 19, 20-27, 50, 117-132. Additionally or alternatively, a fusion protein comprises, or consists essentially of, or yet further consists of an amino acid sequence encoded by an engineered polynucleotide sequence selected from the group of: SEQ ID NOs:68, 54-57, 58, 59, 60-67, 69-70, 136, 145-160 or a fragment thereof, or a sequence at least 90% identical thereto which encodes the same amino acid sequence as encoded by SEQ ID NOs:68, 54-57, 58, or 59, 60-67, 69-70, 136, 145-160 respectively.

In one aspect, any one or more of the above polypeptides or fusion protein further comprises a detectable marker or purification marker.

Further provided are fusion proteins that comprise, or consist essentially of, or yet further consist of the amino acid sequence of SEQ ID NO:18, 19, or an equivalent or a fragment, analogue or variant of each thereof. In one embodiment, also is provided a fusion protein that comprises, or consists essentially of, or yet further consists of the amino acid sequence of SEQ ID NO:24, or an equivalent or a fragment, analogue or variant of each thereof. In another aspect, a fusion protein is provided that comprises, or consists essentially of, or yet further consists of the amino acid sequence of SEQ ID NO:25, or an equivalent or a fragment, analogue or variant thereof. Also further provided are SEQ ID NO:126, 128, or 164-171 or an equivalent of each thereof. Yet further provided are fusion proteins that comprise, or consist essentially of, or yet further consists of any one of the amino acid sequences of SEQ ID NOs:26-28, 38, 50, 126-132, or 164-171, or a fragment, analogue or variant of each. In one aspect, the fusion protein further comprises a detectable or purification marker.

In a further aspect, the fusion protein comprises, or consists essentially of, or yet further consists of a PTEN polypeptide of amino acid SEQ ID NOs.: 2 or 3 or an equivalent thereof. The PTEN polypeptide can be combined with a serum albumin element as described herein. In one aspect the serum albumin comprises, or consists essentially of, or yet further consists of an amino acid of SEQ ID NO:164 or 92 or an equivalent thereof. In a further aspect one, the PTEN and/or serum albumin element comprises, or consists essentially of, or yet further consist of a signal peptide element as described herein, examples of such include SEQ ID NOs:93, 99 or 100, or an equivalent thereof. In a yet further aspect, the PTEN and/or serum albumin element (that optionally comprises a signal peptide) comprises, or consists essentially of, or yet further consists of a linker peptide of amino acid of SEQ ID NOs:48, 106-108, 164, or 165 or an equivalent thereof. In one aspect, the fusion protein comprises, or consists essentially of, or yet further consists of is PR61 (SEQ ID NO:61). Further provided are the polynucleotide encoding these elements alone or in combination with each other. The polypeptide, fusion protein and/or polynucleotides can further comprise a detectable or purification marker.

Further provided are isolated and/or engineered polynucleotides encoding a fusion protein of this disclosure, as well as vectors and host cell systems comprising the polynucleotides. In one aspect, the isolated and/or engineered polynucleotides, vectors or host cells further comprises a detectable or purification marker. In one embodiment, the polynucleotide comprises, or alternatively consists essentially of, or yet further consists of an engineered polynucleotide sequence selected from the group of: SEQ ID NOs: 54-70, 74-77, 135-160 or a fragment thereof. In a further embodiment, the polynucleotide comprises, or alternatively consists essentially of, or yet further consists of a polynucleotide at least 90% identical to any one of SEQ ID NOs: 54-70, 74-77, 135-160 and encoding the same amino acid sequence as SEQ ID NOs: 54-70, 74-77, 135-160, respectively. In one embodiment, the polynucleotide comprises, or alternatively consists essentially of, or yet further consists of an engineered polynucleotide sequence selected from the group of: SEQ ID NOs: 68, 59, 58, 157, 159, 65, or 136, or a fragment thereof. In a further embodiment, the polynucleotide comprises, or alternatively consists essentially of, or yet further consists of a polynucleotide at least 90% identical to any one of SEQ ID NOs: 68, 59, 58, 157, 159, 65, or 136 and encoding the same amino acid sequence as SEQ ID NOs: 68, 59, 58, 157, 159, 65, or 136, respectively. In certain embodiments, the engineered polynucleotide sequence comprises, or alternatively consists essentially of, or yet further consists of one or more engineered polynucleotides selected from any polynucleotides as summarized in Table 1 and listed herein, or a polynucleotide at least 90% identical to each and encoding the same amino acid.

In one aspect, the host cell is a prokaryotic cell or a eukaryotic cell, e.g., a Chinese Hamster Ovary (CHO) cell. In one aspect, the cell comprises, or consists essentially of, or yet further consists of a polynucleotide and/or a vector as disclosed.

The polynucleotides, vectors and host cells are useful for the recombinant production of the fusion proteins. In one aspect, the polynucleotides are sequence-optimized (e.g.

SEQ ID NO:41-47, 54-78, 86, 135-161, 166-167, 171-172, 176-200, and 204-206). Further provided are the methods for producing the recombinant polypeptides produced by expressing the polynucleotides in a host cell and growing the cell under conditions that favor the expression of the polynucleotides. In a further aspect, the recombinant fusion protein is isolated from the cell or culture media. The cells can be prokaryotic or eukaryotic (such as a Chinese Hamster Ovary cell (CHO), and the fusions produced by each cell differ in post-translational modification. The proteins, polypeptides and fusions produced by these methods are also provided.

In one aspect, the fusion protein (for example, the albumin-PTEN fusion protein) is produced by a process comprising the step of culturing a host cell capable of expressing a polynucleotide encoding the fusion protein (e.g., albumin-PTEN fusion protein) under conditions suitable for expression of the fusion protein coding polynucleotide (e.g., albumin-PTEN polynucleotide) and optionally further comprising isolating the fusion protein produced by the cell from the cell culture or culture medium. The cell can be prokaryotic or a eukaryotic, such as a Chinese hamster ovary (CHO) cell. The proteins, polypeptides and fusions produced by these methods are also provided. Additionally provided is a method of producing a fusion protein as disclosed herein. The method comprises culturing a host cell capable of expressing the fusion protein under conditions suitable for expression of the fusion protein and purifying or isolating the fusion protein optionally from the cell or cell culture medium. This method achieves a high yield, and/or a high stability compared to a wildtype PTEN-L protein produced via the same host cell and under the same condition.

Also provided are compositions comprising one or more of the fusion protein(s), polynucleotide(s), vector(s), and/or host cell(s) and a carrier, e.g., a pharmaceutically acceptable carrier. In one embodiment, the vector is a viral vector (for example, an AAV, a HSV, or an adenoviral vector (AdV)) expressing a fusion protein in a host cell and/or in a subject. In one aspect, provided herein are pharmaceutical compositions comprising, or consisting essentially of, or yet further consisting of, the fusion protein, for example, the albumin-PTEN fusion protein as disclosed herein, and at least one pharmaceutically acceptable carrier and optionally a stabilizer or preservative. The compositions optionally comprise an additional therapeutic agent, e.g., a chemotherapeutic agent and/or a combined therapy as disclosed herein.

Thus, further provided are methods for inhibiting the growth of a cancer cell by contacting the cell with an effective amount of one or more of a fusion protein as disclosed herein, a polynucleotide encoding the fusion protein, and/or a vector comprising the polynucleotide. The contacting can be in vitro or in vivo. When practiced in vitro, the methods are useful to test for the effectiveness of the fusion polypeptide against a cancer, alone or in combination with other therapies. When practiced in vitro in an animal, the method provides a convenient animal model to test for effectiveness, alone or in combination with other therapies. In one aspect, the cancer refers to a solid tumor and/or a non-solid (for example, blood) cancer. Additionally or alternatively, the cancer lacks PTEN expression. For example, the cancer has an H score of PTEN staining of about 20 or lower. Method of calculating an H score is available to one of skill in the art, e.g., as disclosed herein. In another aspect, the cancer comprises an increased pi3K pathway pharmacodynamics biomarkers (for example, AKT, pPRAS40, pS6K, pGSK3, pFOXO, or any combination thereof) compared to a control. Such control may be a biological sample from a subject who is free of any cancer or tumor, or a biological sample of another cancer. In a further embodiment, the method comprises contacting the cell with an effective amount of a combinated therapy as disclosed herein.

Also provided are methods to treat cancer in a subject, comprising administering to the subject an effective amount of one or more of a fusion protein/polypeptide, a polynucleotide encoding the fusion protein/polypeptide, and/or a vector comprising the polynucleotide, thereby treating the cancer. In one aspect, the cancer refers to a solid tumor and/or a non-solid (for example, blood) cancer. Additionally or alternatively, the cancer lacks PTEN expression. For example, the cancer has an H score of PTEN staining of about 20 or lower. Method of calculating an H score is available to one of skill in the art, e.g., as disclosed herein. In another aspect, the cancer comprises an increased pi3K pathway pharmacodynamics biomarkers (for example, AKT, pPRAS40, pS6K, pGSK3, pFOXO, or any combination thereof) compared to a control. Such control may be a biological sample from a subject who is free of any cancer or tumor, or a biological sample of another cancer. In a further embodiment, the method comprises administering to the subject an effective amount of a combinated therapy as disclosed herein.

Further provided are methods to deliver a fusion protein/polypeptide, a polynucleotide, a vector, and/or a composition comprising such to a subject by administering an effective amount of one or more of the fusion protein/polypeptide, polynucleotide, and/or vector, thereby delivering the polypeptide, polynucleotide, vector or composition to the subject. Optionally, the fusion protein is delivered to the extracellular matrix (ECM) of a cancer in the subject.

Further provided are kits comprising, or alternatively consisting essentially of, or yet further consisting of one or more of the fusion proteins/polypeptides, polynucleotides encoding them, vectors, or host cells, and optionally a combined therapy and/or instructions for use.

BRIEF DESCRIPTION OF THE DRAWINGS

FIGS. 5A-5B provides results obtained relating to N-terminal thioredoxin-PTEN-M fusion protein. (FIG. 5A) The Sf9 insect/baculovirus system can secrete a N-terminal thioredoxin-PTEN-M fusion (WB, lane 1, upper boxed 82 KDa band; arrow level) and a truncated PTEN-M (WB, lane 1, lower boxed 65 KDa band), while most of the exogenous protein remains intracellular (WB, lanes 3-4). Shown is a WB targeting a C-terminal 6xHis tag (SEQ ID NO: 222) on the protein. However, the 65 KDa band lacks the minimal cell-penetration domain containing the 6Arg (MCPD; SEQ ID NO:39), as determined by LC/MS protein sequencing of the 65 KDa band (FIG. 5B), demonstrating this system altogether has little, if any value for PTEN industrial manufacturing. FIG. 5B discloses SEQ ID NO: 87.

FIGS. 6A to 6E show representative illustrations of fusion proteins and a product plasmid. (FIG. 6A) Cartoons of key mammalian PTEN-albumin fusions disclosed herein. PR402 has the orientation N'-PTEN-L-human serum albumin-C', whereas PR61 has the opposite orientation: N'-human serum albumin-PTEN—S-C'. The inverse versions of both PR402 (e.g. PR3) and PR61 (e.g. PR65) cannot be secreted by CHO-3E7 cells to meaningful amounts. PR407 is PR402 with a Cathepsin B-cleavable linker added in frame between the two domains that can be cleaved by this cancer-associated protease only at the peri-cancerous area. SP: Signal Peptide of human serum albumin (SEQ ID NO:93) that is cleaved upon protein secretion. See examples and Table 1 for further details. FIG. 6A discloses "6His" as SEQ ID NO: 222 and "GFVG" as SEQ ID NO: 107. (FIG. 6B) Schematic representation of PR402-like and PR61-like fusions, and of binding sites and characteristics of key commercially available anti-PTEN and anti-albumin monoclonal antibodies (mAbs). Some of these mAbs are available as HRP-conjugates by the vendor (denoted by stars). Question marks mean the binding site is unknown or presumed. The species selectivity of the mAbs is shown under each box, as follows: M: mouse; R: rat; S: monkey; H: human.(FIG. 6C) Cartoon of the pTT5 mammalian expression vector used to express the various PRs (see Table 1) in this study. The salient features of the vector (e.g. the CMV promoter, polyadenylation signals, the origin of replication etc.) are indicated. Further details can be found at Durocher & Loignon, (2009); and U.S. Pat. No. 8,637,315. Optimized PR cDNAs were cloned as unique EcoRI-HindIII fragments in the vector polylinker. The fragment/vector identity was confirmed with restriction analysis and DNA sequences in all cases. (FIGS. 6D-6E) construction of a recombinant oncolytic HSV-1 vector expressing albumin-PTEN fusions (upper panel) and the genomic coordinates on the HSV genome (lower panel). In the upper panel, the HSV-1 genome is represented as a solid line, whereas the genes of interest are boxed. The cartoon is not drawn to scale. In the lower panel, each primer maps to, for example, the ICP47 upstream flanking region forward primer 47upF (SEQ ID NO:212) binds thymidine 143,675 to cytosine 143,699 of the HSV-1 genome, whereas the rest of the primers' sequence is used for cloning. Numbering refers to NCBI Reference Sequence: NC_001806.2.

FIGS. 10A to 10B show that PR401, PR403 and PR404 are all cleaved by a furin-like protease, whereas while still containing the putative furin-like sequence, PR402 is largely protected.

FIGS. 11A to 11D show that the Minimal Cell Penetration Domain (6xArg (SEQ ID NO: 39)) of PTEN-L is the target of furin-like mediated cleavage. (FIG. 11A) The degradation proneness of PR3 and PR5 cannot be reversed by treatment of cultures with non-specific protease inhibitors like ferric citrate (F; Lonza BE02-043E; diluted to 10x final concentration and given at 1 dpt) or Sigma™ protease inhibitor cocktail (PI; #P1860; given diluted 800x on 1 dpt and 1,600x at 3 dpt); in contrast, PR6 is stable regardless of protease inhibition. U: untreated; M: mock; D lanes: positive control extracts from previous preparations (lane 6D shows some "gel smiling" that was not reproducible). (FIG. 11B) PR3 cleavage is sensitive to a cell-permeable furin peptide inhibitor but the effect is attenuated as the culture continues (F; Merck-Millipore #344930; 50 μM final concentration in 0.5% DMSO). D: DMSO (0.5%); U: untreated. Cell viability was >93.7% at 2 dpt in all cases; at 6 dpt % viabilities were: (73, 79, 88); (83, 91, 90); and (84, 83, 87) for lanes (4-6); (10-12); and (16-18), respectively. (FIG. 11C) A furin-like protease cleaves PR1 within the consensus sequence. FIG. 11C discloses SEQ ID NO: 14. (FIG. 11D) Unlike PR3, PR34 lacks the Minimal Cell Penetration Domain of PTEN-M and is therefore protected from cleavage by a furin-like protease.

(FIG. 12A) Optimization of Signal Peptide (SP) Sequences on PR402. Mature PTEN-L HSA fusion was expressed & secreted under the control of the Human Serum Albumin Signal Peptide (PR402; control), or the Signal Peptide of murine α2-macroglobulin (PR419), murine fibrinogen (PR420), murine α1-antitrypsin (PR421), murine IgGκ chain (PR422), human IgG heavy chain (PR424), human CD33 (PR425), and two artificial SPs from Güler-Gane et al, (2016) PMID: 27195765 (PR426 & PR427). Expression and secretion of the PR428, the murine equivalent of PR402 is shown as well. (FIG. 12B) Unlike a PR402 PTEN-L HSA fusion variant (PR415), a PTEN-M HSA fusion (PR416) cannot be secreted by CHO-3E7 cells. PR415 and PR416 contain a Cys34Ser point mutation of the so-called scavenger Cys34 of HSA. The mutation has no effect on PR415, which is expressed and secreted as well as the control PR402 fusion. (FIG. 12C) Addition of the acidic hemagglutinin (HA) tag upstream of PR402 paradoxically appears to increase secretion in the CHO-3E7 supernatant (PR409). Domain I (aa 1-198) of HSA is insufficient for stabilization and secretion of a PTEN-L-HSA fusion (PR414), whereas at least domains I and II (aa 1-385; PR413), but most preferably the entire HSA (aa 1-585) is required for this purpose. (FIG. 12D) The first 62 aa of HSA are dispensable for PR402 secretion in the CHO cell supernatant, as both PR417 and PR418, which lack the first 34 and 62 aa of mature HSA are expressed to similar levels as the control PR402.

(FIG. 16A) Manufacturing and purification scouting of PR402 by imidazole affinity chromatography (4-12% SDS-PAGE gel stained with Coomasie). Starting (SN; lane 1), flow through (FT; lane 2), wash (3-4) and purified, desalted protein (lane 5) are indicated. Lane 6 corresponds to purified PR402 that was not reduced prior to SDS-PAGE. (FIG. 16B) WB of the indicated lanes from (FIG. 16A) using the F-1 pan-PTEN antibody showing the semi-pure PR402 at 130 KDa.

FIGS. 19A to 19D provide analysis relating to post-translational modification (FIG. 19A) PR402 has exactly the expected sequence, as determined by LC/MS of IMAC-purified (FIGS. 16A to 16B), gel-excised monomeric protein. Coverage was 99.6%. FIG. 19A discloses SEQ ID NO: 28. (FIGS. 19B-19C) The LUD is heavily O-glycosylated with mucin-like structures, as determined by LC/MS of IMAC-purified, gel excised monomeric PR402 and F137 fusions (domain structure: LUD-PTEN—S-HSA and LUD-p53-HSA, respectively). Note that, in contrast to PR402 LC/MS, HSA Signal peptide (SEQ ID NO:93) could be detected in the F137 LC/MS spectra, suggesting that the F137 fusion is not cleaved properly; perhaps that could be a reason why the F137 O-glycan coating is quite heterogeneous. The lower panel shows a graphical alignment of experimentally determined O-glycans for PR402 (upper lines) and F137 (lower lines), indicating high concordance of O-glycan target residues. Boxed amino acids represent O-glycan coated residues. Residues in bold correspond to mutations of the human sequence found in the mouse (S85C and S129G); indicating that S85 and 5129 0-sugar antennas may serve additional functions in humans that are not found in rodents; S116G is the sole PTEN-L mutation found in monkeys, which may also result in a slightly different O-sugar profile between simians and humans within the highly glycosylated S128-130 cluster. FIGS. 19B-19C disclose SEQ ID NOS 5 and 5. (FIG. 19D)N- and O-glycan linked residues of the PTEN-S moiety of PR402 as determined by LC/MS. Tn: Tn antigen (GalNAc); Tf: T antigen (GalNAc-3G); sT: sialyl-T antigen (GalNAc-3SG); 2sT: di-sialyl-T antigen (GalNAc-6S-3SG).

FIGS. 20A to 20H show the PTEN-albumin fusions disclosed herein are functional cell penetrating tumor suppressors. (FIG. 20A) (Upper panel) Exogenous PTEN-M (~70 KDa; stars) contained in a PR5 CHO-3E7 cell supernatant that was placed into contact with either PTEN null (KTOSA) or PTEN-S-null (REM134) cancer cells for 4 h, enters cells and down-regulates the phosphorylation of pS6K. Shown is a WB of total KTOSA and REM134 cell extracts using the pan-PTEN mAb 138G6, a phospho-specific antibody of pS6K(T389) (Cell Signaling catalog #9202), or a β-actin antibody as loading control (Cell Signaling catalog #13E5). (Lower Panel) The same PR5 CHO-3E7 cell supernatant used above was blotted with anti-PTEN and anti-HSA antibodies to visualize PTEN-M-containing (stars) or HSA-containing fragments (crosses). Based on the Ponceau staining of both blots, which was identical (shown here is only the HSA Ponceau S staining), it can be concluded that the PR5 CHO-3E7 supernatant substantially contains albumin degradants and little if any PTEN-M. The 300 KDa band seen on the F-1 blot could be PR5 aggregates or a host cell protein (as in FIG. 7, legend). Mck: mock. (FIG. 20B) PR402 enters PTEN null PC3 prostate cancer cells. PC3 cells were dosed with the indicated final concentrations of IMAC-purified PR402 (as in FIG. 16) for 4 h or 24 h. In lanes 2-4 & 8-10, the semi-pure PR402 stock solution was diluted with fresh culture medium and then added to PC3 cells, whereas in lanes 6 and 12, the stock solution was diluted with an equal volume of a crude, mock-transfected CHO-3E7 supernatant to see if factors in the latter may affect PR402 cell entry. Cell extracts were blotted with the F-1 anti-PTEN mAb, which recognizes several non-specific bands (including the 300 KDa band reported in FIG. 7) that nevertheless serve as internal controls. PR402 entry is already visible at 10 nM PR402 (lane 3) but becomes prominent at 100 nM, especially at 4 h (lanes 4, 6, 10 and 12 at 130 KDa). (FIG. 20C) Two distinct batches of semi-pure PR402 initiate similar levels of apoptosis of PC3 prostate cancer cells after just 1 h of treatment, as measured by the Caspase 3/7-Glo Luciferase assay. (FIG. 20D) PR402 initiates dose-responsive cell death of PTEN null SK-MEL-28 human melanoma cells, as measured by the Caspase 3/7-Glo Luciferase assay. (FIG. 20E) Dose responsive initiation of cell death of mouse 4T1 triple negative breast and mouse ID-8 ovarian cancer cells by PR402, as measured by the Caspase 3/7-Glo Luciferase assay. The GL261 mouse glioblastoma cells resist apoptosis by either PR402 or 1 µM of staurosporine, which serves as positive control for this assay (data not shown; all PR402-responsive cells e.g. 4T1 etc. also responded to staurosporine-initiated cell death). (FIG. 20F) PR61 enters PTEN null PC3 prostate cancer cells to initiate their kill. 500 PC3 cells growing on 96 well plates were washed thoroughly with serum-free growth medium. The wash medium was decanted and replaced with culture supernatant from CHO-3E7 cells that had been transfected with either PR61 (lane 2) or an empty pTT5 vector (lane 4). PC3 Cells were incubated with these CHO-3E7 conditioned media for 2 h at 37° C. The media were then removed and the cells were washed twice in serum-free growth medium and finally lysed in CASP3/7 Titer Glo lysis buffer. Half of the lysate was blotted with an anti-6×His (GenScript; upper panel), whereas the other half of the lysate was processed for Luciferase measurement (lower panel). The result demonstrates that PR61 contained in the CHO-3E7 cell supernatant (lane 3, 61/I standing for input protein) is able to enter PC3 cells and kill them. (FIG. 20G) The FcRn binding domain (HSA dIII) is dispensable for entry of PR61-like proteins in cancer cells. PR67 and PR68 were expressed in CHO-3E7 cells, purified via IMAC to about 70% homogeneity and dialyzed into a pH 20 mM citrate, 150 mM NaCl, 1 mM DTT pH 6.3 buffer (upper panel). The proteins were diluted 1:2 in serum-free growth medium and applied directly onto cells for 1 h. The cell lysate was blotted with an anti-6×His mAb (GenScript) (lower panel). R: Reduced sample; NR: non-reduced sample; Mc: cells treated with serum-free growth medium; B: cells treated with 50% citrate buffer and 50% medium; 137: purified F137 (LUD-p53-HSA) was used as a positive control for cell entry. P: poly-tag protein (GenSript) serving as mAb positive control. (FIG. 20H) F137 is equipotent to PR402 (both used at 1 µM) with respect to the initiation of PC3 cell death, as measured by the Caspase 3/7-Glo Luciferase assay.

(FIG. 21E) Increasing volumes of a crude CHO-3E7 cell supernatant expressing PR61, leading to an estimated final amount of 0-200 ngPR61 was spiked into rat plasma (lanes 1-5) or PBS (lanes 6-10) and then processed for IP-WB using a 138G6/F-10 mAb combination. PR61 (120 KDa) is denoted by stars, whereas the 50 KDa and 70KDa contaminants by crosses. Both contaminants are specifically immuno-precipitated by the 138G6 mAb (compare lane 5 vs. 10). Lane 11 corresponds to a WB of the starting material by F-10 showing the presence of PR61 degradation products in the input which are not recognized by the 138G6 antibody. (FIG. 21F) A crude CHO-3E7 cell supernatant expressing an estimated 50 ng of PR61 (even lanes; stars) or an equal volume of supernatant from mock-transfected CHO-3E7 cells (odd lanes) was spiked into PBS or plasma from a stage IV lung cancer patient (ProMedDx, Norton, MA). Tubes were incubated for t=0 or t=8h at 37° C. and then subjected to IP-WB with an SP218/F-10 Ab combination, as in (FIG. 21E). Like 138G6, the SP218 mAb also specifically IPs the 50 KDa and 70 KDa proteins (lanes 2 & 6 vs. 4 & 8; crosses). Both contaminants are absent from the mock or PR61 preparation (lanes 9-10), indicating that they pre-existed in the serum of the cancer patient. The experiment also demonstrates that PR61 contained in a crude source like the CHO-3E7 supernatant (which is rich in cell debris and proteases released therefrom) is nevertheless very stable upon prolonged incubation (8h) in either PBS (physicochemical stability) or cancer serum (resistance to proteases released from cell debris) (compare PR61 band intensity between lanes 2 & 6 and 4 & 8).

DETAILED DESCRIPTION OF THE DISCLOSURE

Figure 1:
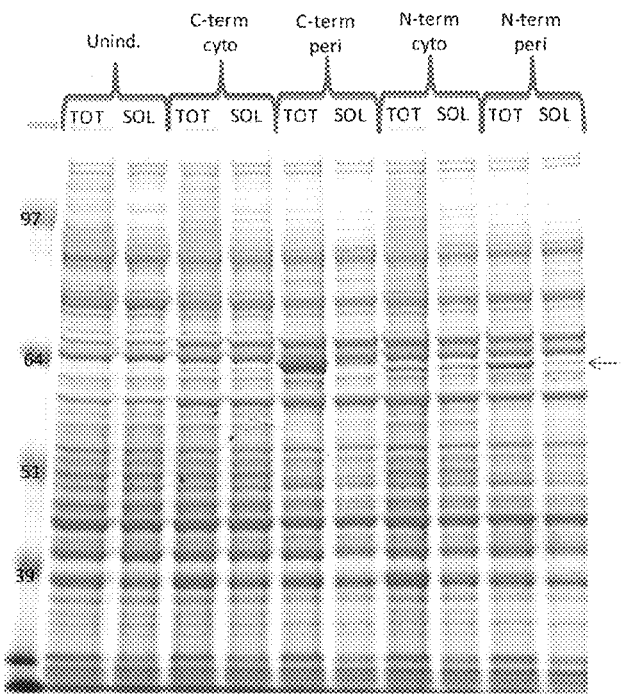
FIG. 1 provide a representative gel result showing that location of the 6×His tag (SEQ ID NO: 222) has an unpredictable impact on PTEN-L expression and solubility but manufacturability remains unacceptable in all cases. Cytoplasm- or periplasm and N' or C'-prime 6×His-tagged PTEN-L variant proteins ("6×His" disclosed as SEQ ID NO: 222) (63 KDa; arrow) were expressed in BL21 *E. coli* under the control of the T5 promoter, as shown. Cells were induced by standard procedures or left uninduced and then lysed in 1×TBS pH 7.4. Total (TOT) and Soluble (SOL) fractions were prepared and run on SDS-PAGE; the gel was stained with Coomasie.

In 2013, PTEN-L (also known as PTEN-Long or PTENα, a translational isoform expressed from the PTEN mRNA via alternative initiation was identified (Hopkins et al. (2013) PMID: 23744781). The full length human pre-PTEN-L protein (SEQ ID NO:1 corresponding to cDNA SEQ ID NO:177) has a PTEN-L Unique Domain ("LUD") of 173 additional amino acids (aa) at the N-terminus of the standard PTEN protein (403 aa, SEQ ID NO:2 corresponding to SEQ ID NO:178; herein referred to as "PTEN-S").

The PTEN proteins are extremely conserved in mammals. For example, PTEN-S is identical between mouse and rat at the amino acid level (SEQ ID NO:88; the corresponding mouse PTEN-S cDNA is SEQ ID NO:166) and has only one Ser>Thr (i.e., Serine to Threonine) conversion (99.9% identity at the amino acid level) vs. human PTEN-S(SEQ ID NO:2), whereas mature mouse PTEN-L (protein SEQ ID NO:89; cDNA SEQ ID NO:167) has only 10 mutations (98.2% identity at the amino acid level) vs. human PTEN-L (SEQ ID NO:3).

Mature human PTEN-L (amino acid (aa) 22-576 of SEQ ID NO:3) is secreted in the blood upon cleavage of a 21-amino acid signal peptide leader sequence (SEQ ID NO:4) from the pre-protein (SEQ ID NO:1). The mature human LUD (aa 22-17 of, SEQ ID: NO:5) contains an arginine-rich, Minimal Cell-Penetration Domain ("MCPD"; protein SEQ ID NO:39, cDNA SEQ ID NO:169; whereas MCPD corresponds to aa47-52 of SEQ ID NO:1) mediating efficient cell entry of PTEN-L in >30 cancer cell lines, yet much less so in "normal" cells (e.g., MCF10A; Hopkins et al, 2013: PMID: 23744781). The MCPD is required for penetration but it may synergize with other determinants such as the Membrane-Binding Domain (MBD; SEQ ID NO:40, which corresponds to aa151-173 of SEQ ID NO:1 at the C-terminal portion of the LUD (Hopkins et al. (2013) PMID: 23744781; Masson et al. (2016) PMID: 26527737). The LUD itself is necessary and sufficient for cellular entry, allowing for subsequent potentiation of anti-cancer action of cargo proteins like PTEN-S and p53 (Hopkins et al. (2013) PMID: 23744781).

Three naturally occurring PTEN-L isoforms or deletion mutants are known, PTEN-M (also referred to herein as PTENβ; SEQ ID: NO 6), PTEN-N(SEQ ID: NO 7) and PTEN-O (SEQ ID: NO 8) (Tzani et al. (2016) PMID: 27249819). Per global convention, amino-acid numbering of the various PTEN isoforms is henceforth based on the longest PTEN-L pre-protein (SEQ ID NO:1; Pulido et al. (2014) PMID: 24985344) unless specified. As such, all variants are considered to be progressive N-terminus deletion mutants of PTEN-L which still contain PTEN-S in consecutive fashion (Malaney et al, 2017: PMID: 28289760), and hence, by extension can be described as having a deletion-specific (M, N & O) Unique Domain fused in frame upstream of PTEN-S, that is namely defined herein as MUD (SEQ ID NO:9), NUD (SEQ ID NO:10) and OUD (SEQ ID NO:11), respectively (Tzani et al, 2016: PMID: 27249819).

Since the catalytic phosphatase domain resides in the common PTEN-S sequence, all PTEN-L isoforms are by definition protein and lipid phosphatases. While PTEN-L is the only one of its peers that can be directly secreted in human serum, PTEN-L and PTEN-M appear to be indistinguishable in terms of cell and nuclear membrane penetration, phosphatase activity and anti-cancer action (Hopkins et al, 2013: PMID: 23744781; Tzani et al, 2016: PMID:

27249819; Liang et al, 2017: PMID: 28332494). Because of its inherent human serum secretion and compatibility, the spontaneous cancer cell permeability, the multivalent mechanism of action (pi3K/AKT/mTOR, ERK, VEGF inhibition), the strong anti-cancer monotherapy action leading to extension of overall survival in cells & xenografts in several preclinical models, the fact that transgenic mice over-expressing the PTEN gene are not only viable and cancer-resistant but also achieve better blood sugar control and live significantly longer than the littermates, PTEN-L is a prime candidate drug for anti-viral and anti-cancer therapy across all oncology and hematology indications (Wu et al, 2017: PMID: 28783500. Lee et al, 2018: PMID: 29858604).

However, in spite of its putative importance as a novel anti-cancer therapeutic, PTEN-L has proven extremely hard to manufacture, given that in all published cases, the protein is reportedly fret with low yields, and physicochemical instability (Hopkins et al, 2013: PMID: 23744781; Masson et al, 2016: PMID: 26527737; Wu et al, 2017 PMID: 28783500).

In contrast to PTEN-L, recombinant PTEN-S or p53 protein does not possess autonomous cell penetration capabilities, wherein expression of PTEN-S within cells requires cell transfection or viral transduction using the PTEN-S cDNA, or encapsulation of the tumor suppressor protein in a membrane-like chemical structure, like a liposome or a cationic lipid (Altinoglu et al, 2016; PMID: 27748775) or via hybrid protein-DNA hybrid nanostructures (Ryu et al, 2020; PMID: 32057052). Once expressed inside cancer cells, however, PTEN-S can cause their death across essentially all known cancer indications. While transfection of PTEN-S has no medical applicability, its protein encapsulation is quite cumbersome from a manufacturing perspective; similarly, tumor suppressor gene therapy has only been approved for Adenoviral-53, and only in China (Gendicine; Goswami et al, 2019; PMID: 31069169). It follows that manufacturable PTEN-S fusion proteins would have much higher medical, therapeutic and commercial value than any other delivery technology known in the art.

However, therapeutically useful proteins, such as the PTEN proteins may not always be "developable". As an example, proteins may be expressed at economically or industrially irrelevant amounts (e.g. <5 µg/ml of secreted protein in the supernatant of transiently transfected CHO cells) or may be biophysically unstable (e.g. due to degradation or aggregation or lack of post-translational modifications in case of bacterial expression) or may have unsuitable pharmacokinetic profiles (e.g. instability in human serum, or very low serum half-life or requirement for special buffers or excipients). The following approaches are known to potentially increase developability and/or improve the medical relevance of such proteins: (a) Genetic fusion of the protein to a naturally long-half-life protein or protein domain such as the Fc (antibody tail) domain, transferrin and human serum albumin (HSA) proteins; or fusion to an inert polypeptide such as XTEN (also known as recombinant PEG or "rPEG"), or a homo amino acid polymer (HAP; HAPylation), or aproline-alanine-serine polymer (PAS; PASylation), or an elastin-like peptide (ELP; ELPylation); (b) Chemical conjugation of the protein to repeat chemical moieties, e.g., to PEG (PEGylation) or hyaluronic acid, so as to increase the hydrodynamic radius of the target protein; (c) Polysialylation of the protein or fusion thereof to a negatively charged, highly sialylated peptide; (d) Non-covalent binding of the protein to normally long-half-life proteins such as Human Serum Albumin (HSA), human IgG, or transferrin; (e) Chemically conjugation of the protein to HSA, Fc or transferrin (reviewed in Strohl, 2015, PMID: 26177629).

Embodiments according to the present disclosure will be described more fully hereinafter. Aspects of the disclosure may, however, be embodied in different forms and should not be construed as limited to the embodiments set forth herein. Rather, these embodiments are provided so that this disclosure will be thorough and complete, and will fully convey the scope of the invention to those skilled in the art. The terminology used in the description herein is for the purpose of describing particular embodiments only and is not intended to be limiting.

Unless otherwise defined, all terms (including technical and scientific terms) used herein have the same meaning as commonly understood by one of ordinary skill in the art to which this invention belongs. It will be further understood that terms, such as those defined in commonly used dictionaries, should be interpreted as having a meaning that is consistent with their meaning in the context of the present application and relevant art and should not be interpreted in an idealized or overly formal sense unless expressly so defined herein. While not explicitly defined below, such terms should be interpreted according to their common meaning.

The terminology used in the description herein is for the purpose of describing particular embodiments only and is not intended to be limiting of the invention. All publications, patent applications, patents and other references mentioned herein are incorporated by reference in their entirety.

The practice of the present technology will employ, unless otherwise indicated, conventional techniques of tissue culture, immunology, molecular biology, microbiology, cell biology, and recombinant DNA, which are within the skill of the art.

Unless the context indicates otherwise, it is specifically intended that the various features of the invention described herein can be used in any combination. Moreover, the disclosure also contemplates that in some embodiments, any feature or combination of features set forth herein can be excluded or omitted. To illustrate, if the specification states that a complex comprises components A, B and C, it is specifically intended that any of A, B or C, or a combination thereof, can be omitted and disclaimed singularly or in any combination.

Unless explicitly indicated otherwise, all specified embodiments, features, and terms intend to include both the recited embodiment, feature, or term and biological equivalents thereof.

All numerical designations, e.g., pH, temperature, time, concentration, and molecular weight, including ranges, are approximations which are varied (+) or (−) by increments of 1.0 or 0.1, as appropriate, or alternatively by a variation of +/−15%, or alternatively 10%, or alternatively 5%, or alternatively 2% and such ranges are included. It is to be understood, although not always explicitly stated, that all numerical designations are preceded by the term "about". It also is to be understood, although not always explicitly stated, that the reagents described herein are merely exemplary and that equivalents of such are known in the art.

Throughout this disclosure, various publications, patents and published patent specifications may be referenced by an identifying citation or by an Arabic numeral. The full citation for the publications identified by an Arabic numeral are found immediately preceding the claims. The disclosures of these publications, patents and published patent specifications are hereby incorporated by reference into the present

Definitions

The practice of the present technology will employ, unless otherwise indicated, conventional techniques of organic chemistry, pharmacology, immunology, molecular biology, microbiology, cell biology and recombinant DNA, which are within the skill of the art. See, e.g., Sambrook, Fritsch and Maniatis, Molecular Cloning: A Laboratory Manual, 2$^{nd}$ edition (1989); Current Protocols In Molecular Biology (F. M. Ausubel, et al. eds., (1987)); the series Methods in Enzymology (Academic Press, Inc.): PCR 2: A Practical Approach (M. J. MacPherson, B. D. Hames and G. R. Taylor eds. (1995)), Harlow and Lane, eds. (1988) Antibodies, a Laboratory Manual, and Animal Cell Culture (R.I. Freshney, ed. (1987)).

As used in the description of the invention and the appended claims, the singular forms "a," "an" and "the" are intended to include the plural forms as well, unless the context clearly indicates otherwise.

As used herein, the term "comprising" is intended to mean that the compositions and methods include the recited elements, but do not exclude others. As used herein, the transitional phrase consisting essentially of (and grammatical variants) is to be interpreted as encompassing the recited materials or steps and those that do not materially affect the basic and novel characteristic(s) of the recited embodiment. Thus, the term "consisting essentially of" as used herein should not be interpreted as equivalent to "comprising". "Consisting of" shall mean excluding more than trace elements of other ingredients and substantial method steps for administering the compositions disclosed herein. Aspects defined by each of these transition terms are within the scope of the present disclosure.

The term "about" as used herein when referring to a measurable value such as an amount or concentration and the like, is meant to encompass variations of 20%, 10%, 5%, 1%, 0.5%, or even 0.1% of the specified amount.

As used herein, the terms "increased", "decreased", "high", "low" or any grammatical variation thereof refer to a variation of about 90%, 80%, 50%, 20%, 10%, 5%, 1%, 0.5%, or even 0.1% of the reference composition, polypeptide, protein, etc.

The phrase "lacks expression of" a protein/polypeptide refers to that (i) the protein/polypeptide is note encoded or present, and/or (2) the protein/polypeptide is present at a low level compared to a control (for example, a non-cancer cell or tissue).

The terms or "acceptable," "effective," or "sufficient" when used to describe the selection of any components, ranges, dose forms, etc. disclosed herein intend that said component, range, dose form, etc. is suitable for the disclosed purpose.

Also as used herein, "and/or" refers to and encompasses any and all possible combinations of one or more of the associated listed items, as well as the lack of combinations when interpreted in the alternative ("or").

The term "fusion protein" refers to a polypeptide comprising amino acid sequences from at least two different sources in tandem. A fusion protein may also be referred to as a fusion polypeptide, a chimeric protein, or a chimeric polypeptide. A fusion protein may be encoded by a nucleic acid molecule having two or more coding regions from different sources that are joined in-frame, such that the nucleic acid molecule encodes the fusion protein. In an embodiment, the fusion protein comprises PTEN-L or PTEN and a second portion comprising human serum albumin and an optional affinity tag. In another embodiment the fusion protein comprises human serum albumin and a second portion comprising PTEN-L or PTEN and an affinity tag. In other embodiments, Once part of the fusion construct or protein, albumin and PTEN or PTEN-L may each be referred to as a "portion," "region" or "moiety" of the said fusion construct or protein.

The term PTEN is an abbreviation of Phosphatase and Tensin Homolog. As used herein it intends a genus of polypeptides or proteins comprising or consisting essentially of, or yet further consisting of, a PTEN or PTEN-L or a fragment, analogue, variant, mutant, isoform or equivalent of the PTEN or PTEN-L with the proviso that the PTEN or PTEN-L enzymatic activity is retained and optionally can be expressed at a reasonable quantity. Such activity can be measured in an in vitro assay such as the Malachite Green phosphatase assay or an in vivo assay, such as an assay measuring cell penetration in a mammalian cell or another cell-based assay measuring PTEN protein tumor suppressor function, such as an assay measuring initiation of cancer cell death as is known in the art or described herein. Non-limiting examples of a PTEN include PTEN-L, PTEN-M, PTEN-N, PTEN-O, PTEN-S and minimal PTEN fragment (which is also referred to herein as minimal PTEN-S). In certain embodiments, the terms PTEN and PTEN-L are used interchangeable, especially when followed by "or a fragment".

In certain embodiments, when referring to an amino acid sequence or a polypeptide or a protein, the term human "PTEN-L" or "PTEN-L portion" or "PTEN-L region" or "PTEN-L moiety" comprises, or consists essentially of, or yet further consists of polypeptides having the SEQ ID NO:1 (human pre-PTEN-L), or SEQ ID NO:3 (mature human PTEN-L) as well as any and all fragments, minimal fragments, analogues, mutant, isoform, equivalent and variants of each thereof.

As used herein, a fragment of a protein or a polypeptide provides a protein or polypeptide truncated at N terminal, C terminal or both.

An equivalent of a protein or a polypeptide (referred to herein as the reference) shares at least 50% (or at least 60%, or at least 70%, or at least 80%, or at least 90%) identity to the reference and retains the reference's function and manufacturability.

As used herein, the terms "function" "activity" and "enzymatic activity" are used interchangeable. For example, an activity of (a) a PTEN, (b) a fragment, analogue, variant, mutant, or equivalent of a PTEN, or (c) a fusion protein comprising (a) and/or (b) may refers to penetrating cell and/or nuclear membrane, acting as a phosphatase and providing an anti-cancer therapeutic result. Such activity can be measured in an in vitro assay such as the Malachite Green phosphatase assay or an in vivo assay, such as an assay measuring cell penetration in a mammalian cell, or another cell-based assay measuring PTEN protein tumor suppressor function, such as an assay measuring initiation of cancer cell death, as is known in the art or described herein.

An equivalent of a polynucleotide (referred to herein as the reference) shares at least 50% (or at least 60%, or at least 70%, or at least 80%, or at least 90%) identity to the reference, and encodes the same polypeptide as the one encoded by the reference, or encodes an equivalent of the polypeptide encoded by the reference.

To arrive at a position or a consecutive segment of a test sequence equivalent to (or corresponding to) an/a amino acid/nucleotide residue or a consecutive segment of a reference sequence, a sequence alignment is performed between the test and reference sequences. The positions or segments aligned to each other are determined as equivalents.

The term "PTEN equivalent," comprises, or consists essentially of, or yet further consists of, polypeptides which can be expressed at a reasonable quantity and which still retains or improves on PTEN protein activity in an in vitro assay such as the Malachite Green phosphatase assay or an in vivo assay, such as an assay measuring cell penetration in a mammalian cell or another cell-based assay measuring PTEN protein tumor suppressor function, such as an assay measuring initiation of cancer cell death, as is known in the art or described herein.

The term "minimal PTEN fragment", comprises, or consists essentially of, or yet further consists of, polypeptides which have one or more modified amino acids, but retain at least 90% sequence similarity or identity with SEQ ID NO:162, and which fragment can be expressed at a reasonable quantity and which fragment still retains or improves on PTEN protein activity in an in vitro assay such as the Malachite Green phosphatase assay or an in vivo assay, such as an assay measuring cell penetration in a mammalian cell or another cell-based assay measuring PTEN protein tumor suppressor function, such as an assay measuring initiation of cancer cell death, as is known in the art [for instance, the minimal PTEN fragment of SEQ ID NO:162 retains catalytic activity in cancer cells (Odriozola et al, 2007; PMID: 17565999)] or described herein.

The term "analogue" refers to an equivalent having one or more modified amino acids and one or more amino acids replaced with another amino acid. Such modification may include but is not limited to conjugation with a molecule (for example, a small molecule, a cytotoxic molecule, a linker, a pH-sensitive linker, and/or a thiol linker), sialylation, polysialylation, O-glycosylation, N-glycosylation, myristoylation, palmitoylation, isoprenylation or prenylation, glipyatyon, lipoylation, phosphopantetheinylation, ethanolamine phosphoglycerol attachment, diphthamide formation, hypusine formation, acylation, acetylation, formylation, alkylation, methylation, amidation, citrullination, deamidation, eliminylation, ISGylation, SUMOylation, ubiquitination, neddylation, pupylation, biotinylation, carbamylation, oxidation, pegylation, glycation, carbamylation, carbonylation, spontaneous isopeptide bond formation, butyrylation, gamma-carboxylation, malonylation, hydroxylation, iodination, nucleotide addition, phosphate ester (O-linked) or phosphoramidate (N-linked) formation, phosphorylation, adenylylation, uridylylation, propionylation, pyroglutamate formation, S-glutathionylation, S-nitrosylation, S-sulfenylation, S-sulfinylation, S-sulfonylation, succinylation, and/or sulfation.

The term "PTEN analogue" comprises, or consists essentially of, or yet further consists of, polypeptides which have one or more modified or replaced amino acids, but retain at least 90% sequence similarity or identity with a PTEN protein (for example, SEQ ID NO:1 or SEQ ID NO:3, including but not limited to human PTEN-M (SEQ ID NO:6), human PTEN-N(SEQ ID NO:7), human PTEN-O (SEQ ID NO:8), human PTEN-S(SEQ ID NO:2), mouse PTEN-S(SEQ ID NO:88), mature mouse PTEN-L (SEQ ID NO:89), which analogue can be expressed at a reasonable quantity and which analogue still retains or improves on PTEN protein activity in an in vitro assay such as the Malachite Green phosphatase assay or an in vivo assay, such as an assay measuring cell penetration in a mammalian cell or another cell-based assay, such as an assay measuring initiation of cancer cell death, as is known in the art or described herein.

As used herein, the term a polypeptide/protein variant comprises, or consists essentially of, or yet further consists of an equivalent of the polypeptide/protein and one or more additional amino acids.

The term "PTEN variant" comprises or consists essentially of, or yet further consists of, polypeptides which have one or more additional amino acids, typically having less than 40 or preferably less than 15 additional amino acids at either the N-terminus or the C-terminus of PTEN protein, or both, which variant can be expressed at a reasonable quantity and which variant still retains or improves on PTEN activity in an in vitro assay such as the Malachite Green phosphatase assay or an in vivo assay, such as an assay measuring cell penetration in a mammalian cell or another cell-based assay, such as an assay measuring initiation of cancer cell death, as is known in the art or described herein.

Human serum albumin (HSA) is a multi-functional protein has a long average half-life in the 19-day range. At a concentration of 50 mg/mL (0.6 mM), HSA is the most abundant protein in human plasma, where it has several functions, including maintenance of plasma pH, metabolite and fatty acid transport, and a role in maintaining blood pressure. HSA, which is at the upper limit of size for glomerular filtration of proteins by the kidney, is strongly anionic, which helps even more to retard its filtration via the kidney. Like IgGs, HSA also binds a specific receptor called FcRn or neonatal receptor in a pH-dependent manner, albeit at a site different from—and via a mechanism distinct from—that of IgG binding, and is recycled similarly to IgGs, resulting in its extended half-life. HSA also tends to accumulate in tumors and in inflamed tissues, which suggests that fusion or binding to albumin may potentially help to target proteins or peptides to those sites. The simian serum albumin (SSA; SEQ ID NO:90), rat serum albumin (RSA; SEQ ID NO:91), mouse serum albumin (MSA SEQ ID NO:92) serve similar functions and are fairly conserved vs. HSA (SEQ ID NO:12-13). All serum albumins (SAs) are secreted from the cell following cleavage of a highly conserved signal peptide (SEQ ID NO:93-96). Several naturally occurring (e.g. the Casebrook D494Q) or engineered (e.g. the D108A) HSA mutations decrease, whereas other engineered mutations (e.g. K573P) increase the mutant HSA's affinity for human FcRn. All SAs consist of 3 major domains, referred as dI (aa1-197), dII (aa198-381) and dIII (aa382-585)(amino acid numbering refers to SEQ ID NO:13) and bind their cognate FcRn via the C-terminal portion of dIII, a region which is quite divergent among mammals. As such, there is remarkable species specificity in SA recycling function by FcRn, whereby injected HSA in living mice for example are ignored by mouse FcRn over the endogenous MSA ligand. The species-specific FcRn-SA binding property appears to have been lost in cultured human or mouse cancer cells—these rapidly take up MSA, RSA or HSA without any obvious restriction (Swiercz et al, 2017; PMID: 27974681). As such, the choice of SA has important implications for therapeutic drug development of albumin fusions, especially with respect to tissue biodistribution of exogenous therapeutic albumin fusions (reviewed in Sand et al, 2015; PMID: 25674083).

The term "serum albumin protein", or "Serum Albumin—SA" which is used interchangeably with "albumin portion" or "albumin region" or "albumin moiety" may refers to "Human Serum Albumin—HSA", or "Simian Serum Albumin—SSA", or "Rat Serum Albumin—RSA" or "Mouse Serum Albumin—MSA". In one embodiment, it comprises, or consists essentially of, or yet further consists of polypeptides having the SEQ ID NO:12 (HSA pre-protein), or SEQ ID NO:13 (mature HSA), or SEQ ID NO:90 (mature SSA), or SEQ ID NO:91 (mature RSA), or SEQ ID NO:92 (mature MSA), as well as any and all fragments, minimal fragments, analogues and variants thereof.

The term "albumin equivalent," comprises, or consists essentially of, or yet further consists of, polypeptides which can be expressed at a reasonable quantity and which still retains or improves on certain albumin properties, including the binding of the albumin fragment to an FcRn receptor, as is known in the art or described herein.

The term "minimal albumin fragment", comprises, or consists essentially of, or yet further consists of, polypeptides which have one or more modified amino acids, but retain at least 90% sequence similarity or identity with SEQ ID NO:163, and which fragment can be expressed at a reasonable quantity and which fragment still retains or improves on certain albumin properties, including the binding of the albumin fragment to an FcRn receptor, as is known in the art or described herein.

The term "albumin analogue" comprises, or consists essentially of, or yet further consists of, polypeptides which have one or more modified or replaced amino acids, but retain at least 90% sequence similarity or identity with a serum albumin (for example, SEQ ID NO:12-13, 90-92 and 163), which analogue can be expressed at a reasonable quantity and which analogue still retains or improves on certain albumin properties, including the binding of the albumin fragment to an FcRn receptor, as is known in the art or described herein.

The term "albumin variant" comprises, or consists essentially of, or yet further consists of, polypeptides which have one or more additional amino acids, but retain at least 90% sequence similarity or identity with SEQ ID NO:12-13, 90-92 and 163, which analogue can be expressed at a reasonable quantity and which analogue still retains or improves on certain albumin properties, including the binding of the albumin fragment to an FcRn receptor, as is known in the art or described herein.

Signal peptides are found in proteins that are targeted to the endoplasmic reticulum and eventually destined to be either secreted/extracellular/periplasmic/etc., retained in the lumen of the endoplasmic reticulum, of the lysosome or of any other organelle along the secretory pathway or to be I single-pass membrane proteins. The signal sequence is usually presented in the pre-protein and/or pro-protein and removed in the mature protein. In certain embodiment, a signal peptide as used herein directs a fusion protein to be secreted from a host cell. In one embodiment, the signal peptide is at the N-terminal of the fusion protein for secretion and/or is selected from the group of: an HSA signal peptide, an SSA signal peptide, an RSA signal peptide, an MSA signal peptide, a signal peptide of murine α2-macroglobulin, a murine fibrinogen signal peptide, a murine α1-antitrypsin signal peptide, a murine IgGκ chain signal peptide, a human IgG heavy chain signal peptide, a human CD33 signal peptide, or an artificial signal peptide. In a further embodiment, the signal peptide comprises an amino acid sequence selected from the group of SEQ ID NOs:93-105. In yet a further embodiment, the signal peptide is encoded by an engineered polynucleotide sequence selected from the group of: SEQ ID NO:180-192, or a sequence at least 90% identical thereto which encodes the same amino acid sequence as SEQ ID NO:93-105, respectively.

The term "affinity tag" refers to a polypeptide that may be included within a fusion protein to allow detection of the fusion protein and/or purification of the fusion protein from the cellular milieu using a ligand that is able to bind to, i.e., has affinity for, the affinity tag. The ligand may be, but is not limited to, an antibody, a resin, or a complementary polypeptide. An affinity tag may comprise a small peptide, commonly a peptide of approximately 4 to 16 amino acids in length, or it may comprise a larger polypeptide. Commonly used affinity tags include polyarginine, FLAG, V5, polyhistidine, c-Myc, Strep II, maltose binding protein (MBP), N-utilization substance protein A (NusA), thioredoxin (Trx), and glutathione S-transferase (GST), among others (for examples, see GST Gene Fusion System Handbook—Sigma-Aldrich). In an embodiment the affinity tag is a polyhistidine tag, for example a His6 tag (SEQ ID NO: 222). The inclusion of an affinity tag in a fusion protein allows the fusion protein to be purified from the cellular milieu by affinity purification, using an affinity medium that is able to tightly and specifically bind the affinity tag. The affinity medium may comprise, for example, a metal-charged resin or a ligand covalently linked to a stationary phase (matrix) such as agarose or metal beads. For example, polyhistidine tagged fusion proteins (also referred to as His tagged fusion proteins) can be recovered by immobilized metal ion chromatography using $Ni^{2+}$ or $Co^{2+}$ loaded resins, anti-FLAG affinity gels may be used to capture FLAG tagged fusion proteins, and glutathione cross-linked to a solid support such as agarose may be used to capture GST tagged fusion proteins.

As used herein the terms "purification", "purifying", or "separating" refer to the process of isolating one or more polypeptides from a complex mixture, such as a cell lysate or a mixture of polypeptides. The purification, separation, or isolation need not be complete, i.e., some components of the complex mixture may remain with the one or more polypeptides after the purification process. However, the product of purification should be enriched for the one or more polypeptides relative to the complex mixture before purification and a significant portion of the other components initially present within the complex mixture should be removed by the purification process.

The term "cell" as used herein may refer to either a prokaryotic or eukaryotic cell, optionally obtained from a subject or a commercially available source.

"Eukaryotic cells" comprise all of the life kingdoms except monera. They can be easily distinguished through a membrane-bound nucleus. Animals, plants, fungi, and protists are eukaryotes or organisms whose cells are organized into complex structures by internal membranes and a cytoskeleton. The most characteristic membrane-bound structure is the nucleus. Unless specifically recited, the term "host" includes a eukaryotic host, including, for example, yeast, higher plant, insect and mammalian cells. Non-limiting examples of eukaryotic cells or hosts include simian, bovine, porcine, murine, rat, avian, reptilian and human, e.g., HEK293 cells, Chinese Hamster Ovary (CHO) cells and 293T cells.

"Prokaryotic cells" that usually lack a nucleus or any other membrane-bound organelles and are divided into two domains, bacteria and archaea. In addition to chromosomal DNA, these cells can also contain genetic information in a circular loop called an episome. Bacterial cells are very small, roughly the size of an animal mitochondrion (about 1-2 m in diameter and 10 m long). Prokaryotic cells feature three major shapes: rod shaped, spherical, and spiral. Instead of going through elaborate replication processes like eukaryotes, bacterial cells divide by binary fission. Examples include but are not limited to *Bacillus* bacteria, *E. coli* bacterium, and *Salmonella* bacterium.

The term "encode" as it is applied to nucleic acid sequences refers to a polynucleotide which is said to "encode" a polypeptide if, in its native state or when manipulated by methods well known to those skilled in the art, can be transcribed and/or translated to produce the mRNA for the polypeptide and/or a fragment thereof. The antisense strand is the complement of such a nucleic acid, and the encoding sequence can be deduced therefrom.

The terms "equivalent" or "biological equivalent" are used interchangeably when referring to a particular molecule, biological, or cellular material and intend those having minimal homology while still maintaining desired structure or functionality (for example, having a similar function activity). It should be understood, without being explicitly stated that when referring to an equivalent or biological equivalent to a reference polypeptide, protein, or polynucleotide, that an equivalent or biological equivalent has the recited structural relationship to the reference polypeptide, protein, or polynucleotide and equivalent or substantially equivalent biological activity. For example, non-limiting examples of equivalent polypeptides, proteins, or polynucleotides include a polypeptide, protein or polynucleotide having at least 60%, or alternatively at least 65%, or alternatively at least 70%, or alternatively at least 75%, or alternatively 80%, or alternatively at least 85%, or alternatively at least 90%, or alternatively at least 95% identity thereto or for polypeptide, polynucleotide or protein sequences across the length of the reference polynucleotide. Alternatively, an equivalent polypeptide is one that is encoded by a polynucleotide or its complement that hybridizes under conditions of high stringency to a polynucleotide encoding such reference polypeptide sequences and that have substantially equivalent or equivalent biological activity. Conditions of high stringency are described herein and incorporated herein by reference. Alternatively, an equivalent thereof is a polypeptide encoded by a polynucleotide or a complement thereto, having at least 70%, or alternatively at least 75%, or alternatively 80%, or alternatively at least 85%, or alternatively at least 90%, or alternatively at least 95% identity, or at least 97% sequence identity across the length of the reference polynucleotide to the reference polynucleotide, e.g., the wild-type polynucleotide. Such equivalent polypeptides have the same biological activity as the reference polynucleotide.

Non-limiting examples of equivalent polypeptides, include a polynucleotide having at least 60%, or alternatively at least 65%, or alternatively at least 70%, or alternatively at least 75%, or alternatively 80%, or alternatively at least 85%, or alternatively at least 90%, or alternatively at least 95%, or alternatively at least 97%, identity to a reference polynucleotide. An equivalent also intends a polynucleotide or its complement that hybridizes under conditions of high stringency to a reference polynucleotide. Such equivalent polypeptides have the same biological activity as the reference polynucleotide.

A polynucleotide or polynucleotide region (or a polypeptide or polypeptide region) having a certain percentage (for example, 80%, 85%, 90%, or 95%) of "sequence identity" to another sequence means that, when aligned, that percentage of bases (or amino acids) are the same in comparing the two sequences across the length of the reference polynucleotide. The alignment and the percent homology or sequence identity can be determined using software programs known in the art, for example those described in Current Protocols in Molecular Biology (Ausubel et al., eds. 1987) Supplement 30, section 7.7.18, Table 7.7.1. In certain embodiments, default parameters are used for alignment. A non-limiting exemplary alignment program is BLAST, using default parameters. In particular, exemplary programs include BLASTN and BLASTP, using the following default parameters: Genetic code=standard; filter=none; strand=both; cut-off=60; expect=10; Matrix=BLOSUM62; Descriptions=50 sequences; sort by=HIGH SCORE; Databases=non-redundant, GenBank+EMBL+DDBJ+PDB+GenBank CDS translations+SwissProtein+SPupdate+PIR. Details of these programs can be found at the following Internet address: ncbi.nlm.nih.gov/cgi-bin/BLAST. Sequence identity and percent identity can be determined by incorporating them into clustalW (available at the web address:genome.jp/tools/clustalw/, last accessed on Jan. 13, 2017).

"Homology" or "identity" or "similarity" refers to sequence similarity between two peptides or between two nucleic acid molecules. Homology can be determined by comparing a position in each sequence that may be aligned for purposes of comparison. When a position in the compared sequence is occupied by the same base or amino acid, then the molecules are homologous at that position. A degree of homology between sequences is a function of the number of matching or homologous positions shared by the sequences. An "unrelated" or "non-homologous" sequence shares less than 40% identity, or alternatively less than 25% identity, with one of the sequences of the present disclosure.

As used herein, the term "at least 90% identical" refers to an identity of two compared sequences (polynucleotides or polypeptides) of about 90% to about 100%. It also include an identity of at least at least 91%, at least 92%, at least 93%, at least 94%, at least 95%, at least 96%, at least 97%, at least 98%, at least 99%, about 91% to about 100%, about 92% to about 100%, about 93% to about 100%, about 94% to about 100%, about 95% to about 100%, about 96% to about 100%, about 97% to about 100%, about 98% to about 100%, or about 99% to about 100%.

"Homology" or "identity" or "similarity" can also refer to two nucleic acid molecules that hybridize under stringent conditions.

As used herein, the terms "retain" "similar" and "same" are used interchangeably while describing a function, an activity or an functional activity of a polynucleotide, a protein and/or a peptide, referring to a functional activity of at least about 20% (including but not limited to: at least about 30%, at least about 40%, at least about 50%, at least about 60%, at least about 70%, at least about 80%, at least about 90%, at least about 95%, at least about 97%, or about 100%) of the activity of the reference protein, polynucleotide and/or peptide.

"Hybridization" refers to a reaction in which one or more polynucleotides react to form a complex that is stabilized via hydrogen bonding between the bases of the nucleotide residues. The hydrogen bonding may occur by Watson-Crick base pairing, Hoogstein binding, or in any other sequence-specific manner. The complex may comprise two strands forming a duplex structure, three or more strands forming a multi-stranded complex, a single self-hybridizing strand, or any combination of these. A hybridization reaction may constitute a step in a more extensive process, such as the initiation of a PCR reaction, or the enzymatic cleavage of a polynucleotide by a ribozyme.

Examples of stringent hybridization conditions include: incubation temperatures of about 25° C. to about 37° C.; hybridization buffer concentrations of about 6×SSC to about 10×SSC; formamide concentrations of about 0% to about 25%; and wash solutions from about 4×SSC to about 8×SSC. Examples of moderate hybridization conditions include: incubation temperatures of about 40° C. to about 50° C.; buffer concentrations of about 9×SSC to about 2×SSC; formamide concentrations of about 30% to about 50%; and wash solutions of about 5×SSC to about 2×SSC. Examples of high stringency conditions include: incubation temperatures of about 55° C. to about 68° C.; buffer concentrations of about 1×SSC to about 0.1×SSC; formamide concentrations of about 55% to about 75%; and wash solutions of about 1×SSC, 0.1×SSC, or deionized water. In general, hybridization incubation times are from 5 minutes to 24 hours, with 1, 2, or more washing steps, and wash incubation times are about 1, 2, or 15 minutes. SSC is 0.15 M NaCl and 15 mM citrate buffer. It is understood that equivalents of SSC using other buffer systems can be employed. In one aspect, an equivalent polynucleotide is one that hybridizes under stringent conditions to a reference polynucleotide or its complement. In another aspect, an equivalent polypeptide is a polypeptide that is encoded by a polynucleotide is one that hybridizes under stringent conditions to a reference polynucleotide or its complement.

As used herein, "expression" refers to the process by which polynucleotides are transcribed into mRNA and/or the process by which the transcribed mRNA is subsequently being translated into peptides, polypeptides, or proteins. If the polynucleotide is derived from genomic DNA, expression may include splicing of the mRNA in a eukaryotic cell.

The term "isolated" or a grammatical variation thereof as used herein refers to molecules or biologicals or cellular materials being substantially free from other materials.

As used herein, the term "functional" may be used to modify any molecule, biological, or cellular material to intend that it accomplishes a particular, specified effect.

As used herein, the terms "nucleic acid sequence" and "polynucleotide" are used interchangeably to refer to a polymeric form of nucleotides of any length, either ribonucleotides or deoxyribonucleotides. Thus, this term includes, but is not limited to, single-, double-, or multi-stranded DNA or RNA, genomic DNA, complementary DNA (cDNA), DNA-RNA hybrids, or a polymer comprising purine and pyrimidine bases or other natural, chemically or biochemically modified, non-natural, or derivatized nucleotide bases. In certain embodiments, the polynucleotide comprises and/or encodes a messenger RNA (mRNA), a short hairpin RNA, and/or small hairpin RNA. In one embodiment, the polynucleotide is or encodes an mRNA. In certain embodiments, the polynucleotide is a double-strand (ds) DNA, such as an engineered ds DNA or a ds cDNA synthesized from a single-stranded RNA.

As used herein, the terms "engineered" "synthetic" "recombinant" and "non-naturally occurring" are interchangeable and indicate intentional human manipulation, for example, a modification from its naturally occurring form, and/or a sequence optimization.

The term "protein", "peptide" and "polypeptide" are used interchangeably and in their broadest sense to refer to a compound of two or more subunits of amino acids, amino acid analogs or peptidomimetics. The subunits may be linked by peptide bonds. In another aspect, the subunit may be linked by other bonds, e.g., ester, ether, etc. A protein or peptide must contain at least two amino acids and no limitation is placed on the maximum number of amino acids which may comprise a protein's or peptide's sequence. As used herein the term "amino acid" refers to either natural and/or unnatural or synthetic amino acids, including glycine and both the D and L optical isomers, amino acid analogs and peptidomimetics.

As used herein, a consecutive amino acid sequence refers to a sequence having at least two amino acids. However, it is noted that a consecutive amino acid sequence of a first part and a second part does not limit the amino acid sequence to have the first part directly conjugated to the second part. It is also possible that the first part is linked to the second part via a third part, such as a link, thus forming one consecutive amino acid sequence.

As used herein, the terms "conjugate," "conjugated," "conjugating," and "conjugation" refer to the formation of a bond between molecules, and in particular between two amino acid sequences and/or two polypeptides. Conjugation can be direct (i.e. a bond) or indirect (i.e. via a further molecule). The conjugation can be covalent or non-covalent.

As used herein a consecutive amino acid sequence may comprise two or more polypeptides conjugated with each other directly or indirectly (for example via a linker).

In one embodiment, a first protein/polypeptide at N terminal (i.e., N') or C terminal (i.e., C') of a second protein/polypeptide indicates the first one is part of the second one and is located at the N' or C' end of the second protein/polypeptide. In another embodiment, it indicates the first protein/polypeptide is not part of the second protein/polypeptide and is conjugated to the N' or C' end of the second one directly or indirectly.

As used herein, a capital letter followed by a number is used to refer to an amino acid in a sequence, wherein the capital letter indicates an amino acid via the standard one-letter amino acid codes and the number provides the position of the amino acid counted from the N terminal of the sequence. For instance, S65 of SEQ ID NO:1 refers to the $65^{th}$ amino acid of SEQ ID NO:1 counted from the N terminal, which is a Serine.

As used herein, the term "recombinant expression system" refers to a genetic construct or constructs for the expression of certain genetic material formed by recombination.

A "gene delivery vehicle" is defined as any molecule that can carry inserted polynucleotides into a host cell. Examples of gene delivery vehicles are liposomes, micelles biocompatible polymers, including natural polymers and synthetic polymers; lipoproteins; polypeptides; polysaccharides; lipopolysaccharides; artificial viral envelopes; metal particles; and bacteria, or viruses, such as rabies virus, flavivirus, lentivirus, baculovirus, adenovirus and retrovirus, bacteriophage, cosmid, plasmid, fungal vectors and other recombination vehicles typically used in the art which have been described for expression in a variety of eukaryotic and prokaryotic hosts, and may be used for gene therapy as well as for simple protein expression.

A polynucleotide disclosed herein can be delivered to a cell or tissue using a gene delivery vehicle. "Gene delivery," "gene transfer" "mRNA-based delivery", "transducing," and the like as used herein, are terms referring to the introduction of an exogenous polynucleotide (sometimes referred to as a "transgene") into a host cell, irrespective of the method used for the introduction. Such methods include a variety of well-known techniques such as vector-mediated gene transfer (by, e.g., viral infection/transfection, or various other protein-based or lipid-based gene delivery complexes, including for example protamine complexes, lipid nanoparticles, polymeric nanoparticles, lipid-polymer hybrid nanoparticles, and inorganic nanoparticles, or combinations thereof) as well as techniques facilitating the delivery of "naked" polynucleotides (such as electroporation, "gene gun" delivery and various other techniques used for the introduction of polynucleotides). The introduced polynucleotide can be unmodified or can comprise one or more modifications; for example, a modified mRNA may comprise ARCA capping; enzymatic polyadenylation to add a tail of 100-250 adenosine residues (SEQ ID NO: 223); and substitution of one or both of cytidine with 5-methylcytidine and/or uridine with pseudouridine. The introduced polynucleotide may be stably or transiently maintained in the host cell. Stable maintenance typically requires that the introduced polynucleotide either contains an origin of replication compatible with the host cell or integrates into a replicon of the host cell such as an extrachromosomal replicon (e.g., a plasmid) or a nuclear or mitochondrial chromosome. A number of vectors are known to be capable of mediating transfer of genes to mammalian cells, as is known in the art and described herein.

MicroRNAs (miRNAs) are small, 22-25 nucleotide noncoding sequences of RNA. These sequences control gene expression either by translational repression or degradation of the messenger RNA transcript after targeting the 3'UTR. miRNA sequences are highly conserved across all species, demonstrating the important roles that miRNAs play in cellular differentiation, proliferation and cell cycle control. It is now recognized that miRNAs are frequently de-regulated in malignancy, wherein they can be down-regulated or up-regulated. For example, under-expressed miRNAs such as let-7 in lung cancer and mirs-15/16 in leukemia, are tumor suppressor miRNAs, suppressing Ras and BCL2 respectively. In contrast, various miRNAs target the 3' of the PTEN tumor suppressor mRNA, thereby promoting loss of functional PTEN expression (onco-miRs). Non-limiting examples of these onco-miRs includemiR-106a, miR-130a, miR-181b-1, miR-21, miR-214, miR-26a-5p, miR-301a, miR-486-5p, mir-1273g-3p, miR-200b, miR-26a, miR-103, miR-106b, miR-106b-93, miR-107, miR-10b, miR-1297, miR-130, mir-130b, miR-142-5p, miR-144, miR-146b, miR-153, miR-155, miR-17, miR-17-5p, miR-181, miR-181a, miR-181c, miR-18a, miR-19, miR-197-3p, miR-19a, miR-19b, miR-200, miR-200a, miR-205, miR-205-5p, miR-20b, miR-218, miR-22, miR-221, miR-222, miR-224, miR-23a, miR-23b-3p, miR-25, mir-29c, miR-301a-3p, miR-32-5p, miR-335, miR-338-3p, miR-374a, miR-410-3p, miR-4299, miR-454, miR-494, miR-543, miR-548, miR-616-3p, miR-7, miR-718, miR-9, miR-92a, miR-92b, miR-93, miR-93-5p, miR-940 and miR-let 7b. Tumor suppressing miRNAs or onco-miR antagonists (antago-miRs) can be effectively delivered into a subject using aforementioned delivery methods, so as to increase the levels of the PTEN tumor suppressor. Furthermore, the levels of select onco-miRs of the above list, namelymiR-106a, miR-130a, miR-181b-1, miR-21, miR-214, miR-26a-5p, miR-301a, miR-486-5p) that circulate in the blood of a patient are prognostic for the existence of functional PTEN tumor suppressor in a subject. As non-limiting examples, Li et al 2018; PMID: 29316891 found miR-486-5p is significantly overexpressed in cervical cancer patients' serum and tissues as compared to control patients, whereas miR-486-5p directly targets the 3'-untranslated region of the tumor-suppressor gene PTEN, inhibiting its expression, and that overexpression of miR-486-5p activates the PI3K/Akt pathway. In another example, the serum/plasma levels of miR-21 were found to be inversely correlated with and fully prognostic of PTEN protein levels in a variety of cancers (including gastric, colorectal, triple negative breast cancer etc.), in the context of both xenografted mouse tumors and human cancer patients (reviewed in Feng & Tsao, 2016; PMID: 27699004). Hence, onco-miR blood levels, such as miR-21 plasma levels in a subject can serve as a liquid biopsy, which is generally defined as an assay analyzing proteins, DNA, or cancer cells that circulate in the blood of a subject.

A "plasmid" is an extra-chromosomal DNA molecule separate from the chromosomal DNA which is capable of replicating independently of the chromosomal DNA. In many cases, it is circular and double-stranded. Plasmids provide a mechanism for horizontal gene transfer within a population of microbes and typically provide a selective advantage under a given environmental state. Plasmids may carry genes that provide resistance to naturally occurring antibiotics in a competitive environmental niche, or alternatively the proteins produced may act as toxins under similar circumstances.

"Plasmids" used in genetic engineering are called "plasmid vectors". Many plasmids are commercially available for such uses. The gene to be replicated is inserted into copies of a plasmid containing genes that make cells resistant to particular antibiotics and a multiple cloning site (MCS, or polylinker), which is a short region containing several commonly used restriction sites allowing the easy insertion of DNA fragments at this location. Another major use of plasmids is to make large amounts of proteins. In this case, researchers grow bacteria containing a plasmid harboring the gene of interest. Just as the bacterium produces proteins to confer its antibiotic resistance, it can also be induced to produce large amounts of proteins from the inserted gene.

A "yeast artificial chromosome" or "YAC" refers to a vector used to clone large DNA fragments (larger than 100 kb and up to 3000 kb). It is an artificially constructed chromosome and contains the telomeric, centromeric, and replication origin sequences needed for replication and preservation in yeast cells. Built using an initial circular plasmid, they are linearized by using restriction enzymes, and then DNA ligase can add a sequence or gene of interest within the linear molecule by the use of cohesive ends. Yeast expression vectors, such as YACs, YIps (yeast integrating plasmid), and YEps (yeast episomal plasmid), are extremely useful as one can get eukaryotic protein products with posttranslational modifications as yeasts are themselves eukaryotic cells, however YACs have been found to be more unstable than BACs, producing chimeric effects.

A "viral vector" is defined as a recombinantly produced virus or viral particle that comprises a polynucleotide to be delivered into a host cell, either in vivo, ex vivo or in vitro. Examples of viral vectors include retroviral vectors, adenovirus vectors, adeno-associated virus vectors, herpes simplex virus vectors, alphavirus vectors and the like.

Research on developing novel viral vectors is advancing steadily with a special focus on substituting pathogenic genes with therapeutic DNA. In fact, non-pathogenic, replication-defective, and human friendly viral vectors are being used in more than 70% of the ongoing gene therapy clinical trials worldwide. One particularly popular use of viral vectors, such as adenovirus, Seneca Valley virus, poliovirus, vaccinia virus, herpes simplex virus, reovirus, Coxsackievirus, parvovirus, Newcastle disease virus, vesicular stomatitis virus, and measles virus, is in the form of oncolytic viruses (OV). In 2016 alone, more than 40 clinical trials using OV were conducted. OV destroy malignant cancer cells by specifically replicating in those cells to effectively lyse them as well as induce a robust antitumor immune response. OV selectively replicate in tumor cells through a variety of methods such as virus-specific receptors on the cells. They can be used to deliver anti-angiogenesis genes, suicide genes, immunostimulatory genes, and DNA encoding small nucleic acids. Apart from carrying immunostimulatory genes, OV can induce an immune response by releasing cell debris and viral antigens (Goswami et al, 2019; PMID: 31069169).

Infectious tobacco mosaic virus (TMV)-based vectors can be used to manufacturer proteins and have been reported to express Griffithsin in tobacco leaves (O'Keefe et al. (2009) Proc. Nat. Acad. Sci. USA 106(15):6099-6104). Alphavirus vectors, such as Semliki Forest virus-based vectors and Sindbis virus-based vectors, have also been developed for use in gene therapy and immunotherapy. See, Schlesinger & Dubensky (1999) Curr. Opin. Biotechnol. 5:434-439 and Ying et al. (1999) Nat. Med. 5(7):823-827. In aspects where gene transfer is mediated by a retroviral vector, a vector construct refers to the polynucleotide comprising the retroviral genome or part thereof, and a therapeutic gene. Further details as to modern methods of vectors for use in gene transfer may be found in, for example, Kotterman et al. (2015) Viral Vectors for Gene Therapy: Translational and Clinical Outlook Annual Review of Biomedical Engineering 17.

As used herein, "retroviral mediated gene transfer" or "retroviral transduction" carries the same meaning and refers to the process by which a gene or nucleic acid sequences are stably transferred into the host cell by virtue of the virus entering the cell and integrating its genome into the host cell genome. The virus can enter the host cell via its normal mechanism of infection or be modified such that it binds to a different host cell surface receptor or ligand to enter the cell. As used herein, retroviral vector refers to a viral particle capable of introducing exogenous nucleic acid into a cell through a viral or viral-like entry mechanism.

Retroviruses carry their genetic information in the form of RNA; however, once the virus infects a cell, the RNA is reverse-transcribed into the DNA form which integrates into the genomic DNA of the infected cell. The integrated DNA form is called a provirus.

Adenoviruses (AdVs) are a relatively well characterized, homogenous group of viruses, including over 50 serotypes. The seroprevalence of the most commonly used Ad serotype, serotype 5, is approximately 50% in North America and reaches nearly 100% is some regions of Africa, while the seroprevalences of Ad3 and Ad35 in the US are around 100% and 3%-22%, respectively. AdVs do not require integration into the host cell genome. Recombinant Ad derived vectors, particularly those that reduce the potential for recombination and generation of wild-type virus, have also been constructed.

DNA viral vectors, such as an adenovirus (AdV), herpes simplex virus (HSV) or adeno-associated virus (AAV), comprising a viral genome or a fragment thereof, and a polynucleotide encoding a protein of interest (which is also referred to herein as a transgene) are commercially available from sources such as Takara Bio USA (Mountain View, Calif.), Vector Biolabs (Philadelphia, Pa.), and Creative Biogene (Shirley, N.Y.). Wild-type AAV has high infectivity and specificity integrating into the host cell's genome. See, Wold and Toth (2013) Curr. Gene. Ther. 13(6):421-433, Hermonat&Muzyczka (1984) Proc. Natl. Acad. Sci. USA 81:6466-6470, and Lebkowski et al. (1988) Mol. Cell. Biol. 8:3988-3996.

Vectors that contain both a promoter and a cloning site into which a polynucleotide can be operatively linked are well known in the art. Such vectors are capable of transcribing RNA in vitro or in vivo, and are commercially available from sources such as Agilent Technologies (Santa Clara, Calif.) and Promega Biotech (Madison, Wis.). In order to optimize expression and/or in vitro transcription, it may be necessary to remove, add or alter 5' and/or 3' untranslated portions of the clones to eliminate extra, potential inappropriate alternative translation initiation codons or other sequences that may interfere with or reduce expression, either at the level of transcription or translation. Alternatively, consensus ribosome binding sites can be inserted immediately 5' of the start codon to enhance expression.

Gene delivery vehicles also include DNA/liposome complexes, micelles and targeted viral protein-DNA complexes. Liposomes that also comprise a targeting antibody or fragment thereof can be used in the methods disclosed herein. In addition to the delivery of polynucleotides to a cell or cell population, direct introduction of the proteins described herein to the cell or cell population can be done by the non-limiting technique of protein transfection, alternatively culturing conditions that can enhance the expression and/or promote the activity of the proteins disclosed herein are other non-limiting techniques.

As used herein, the term "viral capsid" or "capsid" refers to the proteinaceous shell or coat of a viral particle. Capsids function to encapsidate, protect, transport, and release into host cell a viral genome. Capsids are generally comprised of oligomeric structural subunits of protein ("capsid proteins"). As used herein, the term "encapsidated" means enclosed within a viral capsid.

As used herein, the term "helper" in reference to a virus or plasmid refers to a virus or plasmid used to provide the additional components necessary for replication and packaging of a viral particle or recombinant viral particle, such as the modified AAV disclosed herein. The components encoded by a helper virus may include any genes required for virion assembly, encapsidation, genome replication, and/or packaging. For example, the helper virus may encode necessary enzymes for the replication of the viral genome. Non-limiting examples of helper viruses and plasmids suitable for use with AAV constructs include pHELP (plasmid), adenovirus (virus), or herpesvirus (virus).

As used herein, the term "AAV" is a standard abbreviation for adeno-associated virus. Adeno-associated virus is a single-stranded DNA parvovirus that grows only in cells in which certain functions are provided by a co-infecting helper virus. General information and reviews of AAV can be found in, for example, Carter, 1989, Handbook of Parvoviruses, Vol. 1, pp. 169-228, and Berns, 1990, Virology, pp. 1743-1764, Raven Press, (New York). It is fully expected that the same principles described in these reviews are applicable to additional AAV serotypes characterized after the publication dates of the reviews because it is well known that the various serotypes are quite closely related, both structurally and functionally, even at the genetic level (see, for example, Blacklowe, 1988, pp. 165-174 of Parvoviruses and Human Disease, J. R. Pattison, ed.; and Rose, Comprehensive Virology 3: 1-61 (1974)). For example, all AAV serotypes apparently exhibit very similar replication properties mediated by homologous rep genes; and all bear three related capsid proteins such as those expressed in AAV2. The degree of relatedness is further suggested by heteroduplex analysis which reveals extensive cross-hybridization between serotypes along the length of the genome; and the presence of analogous self-annealing segments at the termini that correspond to "inverted terminal repeat sequences" (ITRs). The similar infectivity patterns also suggest that the replication functions in each serotype are under similar regulatory control.

An "AAV vector" as used herein refers to a vector comprising one or more polynucleotides of interest (or transgenes) that are flanked by AAV terminal repeat sequences (ITRs). Such AAV vectors can be replicated and packaged into infectious viral particles when present in a host cell that has been transfected with a vector encoding and expressing rep and cap gene products.

An "AAV virion" or "AAV viral particle" or "AAV vector particle" refers to a viral particle composed of at least one AAV capsid protein and an encapsidated polynucleotide AAV vector. If the particle comprises a heterologous polynucleotide (i.e., a polynucleotide other than a wild-type AAV genome such as a transgene to be delivered to a mammalian cell), it is typically referred to as an "AAV vector particle" or simply an "AAV vector". Thus, production of AAV vector particle necessarily includes production of AAV vector, as such a vector is contained within an AAV vector particle.

Adeno-associated virus (AAV) is a replication-deficient parvovirus, the single-stranded DNA genome of which is about 4.7 kb in length including two 145 nucleotide inverted terminal repeat (ITRs). There are multiple serotypes of AAV. The nucleotide sequences of the genomes of the AAV serotypes are known. For example, the complete genome of AAV-1 is provided in GenBank Accession No. NC_002077; the complete genome of AAV-2 is provided in GenBank Accession No. NC_001401 and Srivastava et al., J. Virol., 45: 555-564 (1983); the complete genome of AAV-3 is provided in GenBank Accession No. NC_1829; the complete genome of AAV-4 is provided in GenBank Accession No. NC_001829; the AAV-5 genome is provided in GenBank Accession No. AF085716; the complete genome of AAV-6 is provided in GenBank Accession No. NC_00 1862; at least portions of AAV-7 and AAV-8 genomes are provided in GenBank Accession Nos. AX753246 and AX753249, respectively; the AAV-9 genome is provided in Gao et al., J. Virol., 78: 6381-6388 (2004); the AAV-10 genome is provided in Mol. Ther., 13(1): 67-76 (2006); and the AAV-11 genome is provided in Virology, 330(2): 375-383 (2004). The sequence of the AAV rh.74 genome is provided in U.S. Pat. No. 9,434,928, incorporated herein by reference. Cis-acting sequences directing viral DNA replication (rep), encapsidation/packaging and host cell chromosome integration are contained within the AAV ITRs. Three AAV promoters (named p5, p19, and p40 for their relative map locations) drive the expression of the two AAV internal open reading frames encoding rep and cap genes. The two rep promoters (p5 and pi 9), coupled with the differential splicing of the single AAV intron (at nucleotides 2107 and 2227), result in the production of four rep proteins (rep 78, rep 68, rep 52, and rep 40) from the rep gene. Rep proteins possess multiple enzymatic properties that are ultimately responsible for replicating the viral genome. The cap gene is expressed from the p40 promoter and it encodes the three capsid proteins VP1, VP2, and VP3. Alternative splicing and non-consensus translational start sites are responsible for the production of the three related capsid proteins. A single consensus polyadenylation site is located at map position 95 of the AAV genome. The life cycle and genetics of AAV are reviewed in Muzyczka, Current Topics in Microbiology and Immunology, 158: 97-129 (1992).

AAV possesses unique features that make it attractive as a vector for delivering foreign DNA to cells, for example, in gene therapy. AAV infection of cells in culture is noncytopathic, and natural infection of humans and other animals is silent and asymptomatic. Moreover, AAV infects many mammalian cells allowing the possibility of targeting many different tissues in vivo. Moreover, AAV transduces slowly dividing and non-dividing cells, and can persist essentially for the lifetime of those cells as a transcriptionally active nuclear episome (extrachromosomal element). The AAV proviral genome is inserted as cloned DNA in plasmids, which makes construction of recombinant genomes feasible. Furthermore, because the signals directing AAV replication and genome encapsidation are contained within the ITRs of the AAV genome, some or all of the internal approximately 4.3 kb of the genome (encoding replication and structural capsid proteins, rep-cap) may be replaced with foreign DNA. To generate AAV vectors, the rep and cap proteins may be provided in trans. Another significant feature of AAV is that it is an extremely stable and hearty virus. It easily withstands the conditions used to inactivate adenovirus (56 to 65° C. for several hours), making cold preservation of AAV less critical. AAV may even be lyophilized. Finally, AAV-infected cells are not resistant to superinfection.

Multiple studies have demonstrated long-term (>1.5 years) recombinant AAV-mediated protein expression in muscle. See, Clark et al., Hum Gene Ther, 8: 659-669 (1997); Kessler et al., Proc Nat. Acad Sc. USA, 93: 14082-14087 (1996); and Xiao et al., J Virol, 70: 8098-8108 (1996). See also, Chao et al., Mol Ther, 2:619-623 (2000) and Chao et al., Mol Ther, 4:217-222 (2001). Moreover, because muscle is highly vascularized, recombinant AAV transduction has resulted in the appearance of transgene products in the systemic circulation following intramuscular injection as described in Herzog et al., Proc Natl Acad Sci USA, 94: 5804-5809 (1997) and Murphy et al., Proc Natl Acad Sci USA, 94: 13921-13926 (1997). Moreover, Lewis et al., J Virol, 76: 8769-8775 (2002) demonstrated that skeletal myofibers possess the necessary cellular factors for correct antibody glycosylation, folding, and secretion, indicating that muscle is capable of stable expression of secreted protein therapeutics. AAV DNA in the rAAV genomes may be from any AAV serotype for which a recombinant virus can be derived including, but not limited to, AAV serotypes AAV-1, AAV-2, AAV-3, AAV-4, AAV-5, AAV-6, AAV-7, AAV-8, AAV-9, AAV-10, AAV-11, AAV-12, AAV-13 and AAV rh74. Production of pseudotyped rAAV is disclosed in, for example, WO 01/83692. Other types of rAAV variants, for example rAAV with capsid mutations, are also contemplated. See, for example, Marsic et al., Molecular Therapy, 22(11): 1900-1909 (2014). The nucleotide sequences of the genomes of various AAV serotypes are known in the art.

Herpes Simplex Viruses ("HSVs") are believed to have tremendous potential as a preventative and therapeutic vaccine against cancer and other diseases because of their ability to evade the immune system and circulating anti-viral drugs, deliver multiple genes, infect a wide variety of cells, pose low risk of adverse health effects, and multiply specifically in tumor cells. They are large enveloped viruses that carry a linear dsDNA of 120-240 kb and infect reptiles, birds, fish, amphibians, and mammals. There are eight known human herpesviruses: herpes simplex virus-1 (HSV-1), herpes simplex virus-2 (HSV-2), human cytomegalovirus (HCMV), varicella-zoster virus (VZV), Epstein-Barr virus (EBV), Kaposi's sarcoma-associated herpesvirus (KSHV), and human herpesviruses 6 and 7 grouped under alpha, beta, and gamma genera. HSV vectors are generally constructed by homologous recombination in eukaryotic cells by co-transfecting the viral genome and a plasmid carrying the therapeutic gene flanked by the sequences homologous to the target locus on viral genome to undergo recombination. The replication-incompetent vectors are created by either mutating or deleting several immediate early genes including ICP4 and ICP27 that are essential for replication and, therefore, can grow only in specifically designed cell lines complemented transiently. For example, Vero-7b cell line is capable of providing in trans the proteins encoded by deleted viral genes. They are safe and non-inflammatory advanced vector platforms known to persist and express in the nerve cells for life and therefore used to treat neuropathic, inflammatory, and cancer-associated pain. The helper-dependent HSV vectors, or amplicon vectors, carry deletions in one or more non-essential genes and retain the ability to replicate in vitro but are compromised in vivo in a context-dependent manner. These viruses are the same as wild type HSV, with plasmids containing a packaging signal and the gene of interest. Amplicons have the ability to accommodate a very large therapeutic sequence up to 100 kb in size but have production and stability issues. The replication-incompetent vectors and amplicons have been used to express genes in the nervous system, muscle, heart, and liver.

An oncolytic HSV-1 carrying PTEN-L has been successfully used to treat brain cancer (Russell et al, 2018; PMID: 30479334), whereas additional examples including the FDA-approved T-Vec HSV drug are reviewed in Goswami et al, 2019 (PMID: 31069169).

In one embodiment, provided is a HSV vector comprising a HSV viral genome or a fragment thereof and a polynucleotide encoding a fusion protein. In a further embodiment, the HSV vector is generated from the HSV-1 strain 17 [152,222 bp; NCBI Reference Sequence: NC 001806.2; National (UK) Collection of Pathogenic Viruses, catalog #0104151v]. Methods of creating such a HSV vector from a known HSV vector (such as HSV-1 strain 17) can be found in the Examples. In yet a further embodiment, the HSV vector lacks one or both ICP47 and ICP34.5 virulent HSV genes. In one embodiment, one or more of the ICP34.5 gene is replaced with a polynucleotide encoding a fusion protein. In a further embodiment, the polynucleotide further comprises regulatory sequences which direct the fusion protein's expression. Optionally, the regulatory sequences comprises a CMV promoter and/or a CMVS promoter. Additionally or alternatively, the polynucleotide comprises an albumin-PTEN fusion cDNAs disclosed herein, such as one or more of SEQ ID NO:54-70, 74-77, or 135-160. In one embodiment, the polynucleotide comprises the cDNA of SEQ ID NO:68 or an equivalent thereof and expresses the PR402 protein with SEQ ID NO:28. In another embodiment, the polynucleotide comprises the cDNA of SEQ ID NO:59 or an equivalent thereof and expresses the PR61 protein with SEQ ID NO:19. In yet another embodiment, the polynucleotide comprises the cDNA of SEQ ID NO:65 or an equivalent thereof and expresses the PR33 protein with SEQ ID NO:25. In one embodiment, the polynucleotide comprises the cDNA of SEQ ID NO:136 or an equivalent thereof and expresses the PR34 protein with SEQ ID NO:50. In one embodiment, the HSV vector is anHSV-1/17/447/434.5-PRn as illustrated in FIGS. 6D-6E which lacks ICP47 and replaces ICP34.5 gene(s) with a polynucleotide encoding a fusion protein under the regulation of a CMV promoter. Further provided is a host cell infected with an HSV as disclosed herein for producing the HSV and/or expressing a fusion protein. In one embodiment, the host cell is a permissive cell, which is a cell that allows a virus circumvent its defenses and replicate. Additionally or alternatively, the host cell comprises receptors mediating HSV entry, including but not limited to nectin-1, herpes virus entry mediator (HVEM) or 3-O-sulfated heparan sulfate. In a further embodiment, the host cell is selected from the group of 4T1, MDAMB468, or PC3 cells. In one embodiment, the polynucleotide encodes a fusion protein having an amino acid sequence selected from SEQ ID NO: 14-30, 34-37, 49-50 and 109-132. In another embodiment, the recombinant oncolytic HSV is constructed using CRISPR or TALEN methodology. In one embodiment, the virus is HSV-1. In another embodiment the HSV virus is HSV-2. In another embodiment, the polynucleotide encoding a fusion protein comprises a polypeptide encoding an N-terminal signal peptide, optionally selected of [nt(1-63) of SEQ ID NO: 171 or SEQ ID NO: 180-192]. In another embodiment, the fusion protein lacks a signal peptide but comprises an initiator methionine residue (optionally encoded by an ATG codon) at the N-terminal of either albumin or PTEN, respectively, as appropriate. In another embodiment, the fusion protein lacks signal peptide but comprises an initiator methionine (optionally encoded by an ATG codon) replacing the first residue of albumin (for example, mature albumin, optionally via replacing the first three nucleotides of the albumin coding polynucleotide with ATG, and further optionally the albumin coding polypeptide is selected from SEQ ID NO:176-179) or of PTEN [for example, a mature PTEN-L, optionally via replacing the first three nucleotides of the PTEN coding polynucleotide with ATG, and further optionally the PTEN coding polynucleotide comprises a sequence selected from SEQ ID NO:167 or nucleotide (nt) 64-nt 1728 of SEQ ID NO:171], as appropriate. In another embodiment, the recombinant oncolytic HSV virus carries/comprises one albumin-PTEN fusion cDNA selected of SEQ ID NO:54-70, 74-77, 135-160. In another embodiment the virus carries/comprises two or more albumin-PTEN fusion cDNAs selected of SEQ ID NO:54-70, 74-77 or 135-160. In another embodiment, the recombinant oncolytic HSV virus or another other vector as disclosed herein further comprises a polynucleotide encoding a fusion protein. In a further embodiment, the polynucleotide is selected from SEQ ID NO:54-70, 74-77, or 135-160. Additionally or alternatively, the recombinant oncolytic HSV virus or any other vector as disclosed herein comprises a polynucleotide encoding a further fusion protein which comprises an amino acid sequence of an albumin and an amino acid sequence of a p53 protein. As used herein, the fusion protein comprising the amino acid sequences of albumin and p53 protein is referred to herein as an albumin-p53 protein. In a further embodiment, the polynucleotide encoding an albumin-p53 protein is selected from SEQ ID NO:78 or 161. In certain embodiments, the recombinant viral vector and/or any vector as described herein further comprises a polynucleotide encoding all or a portion of a heterologous protein or polypeptide.

In one embodiment, the heterologous protein is heterologous to the viral vector. In a further embodiment, the heterologous protein is heterologous to the fusion protein, such as heterologous to human if the PTEN and/or albumin is a human one. In yet a further embodiment, the heterologous protein is a non-naturally occurring protein. In one embodiment, the heterologous protein comprises, or consists essentially of, or yet further consists of a PTEN or a fragment, analogue, variant, mutant, isoform or equivalent thereof. In one embodiment, the heterologous protein further comprises a signal peptide and/or a detectable or purification marker. In one embodiment, the heterologous protein lacks an amino acid sequence of albumin. In a further embodiment, the heterologous protein comprises, or consists essentially of, or yet further consists of a PTEN-L or a fragment, analogue, variant, mutant, isoform or equivalent thereof. In yet a further embodiment, the heterologous protein comprises an amino acid sequence selected from SEQ ID NOs: 31 to 33 or a fragment, analogue, variant, mutant, isoform or equivalent of each. In one embodiment, the heterologous protein is encoded by a polynucleotide comprising a sequence selected from SEQ ID NOs: 71-73, 171-72, 166-167, 198-200, 204-206, a fragment thereof, or a polynucleotide at least 90% identical to SEQ ID NOs: 71-73, 171-72, 166-167, 198-200, 204-206 and encoding the same amino acid sequence as by SEQ ID NOs: 71-73, 171-72, 166-167, 198-200, 204-206, respectively. In another embodiment, the heterologous protein can be used in treating a cancer, such as an antibody or a fragment thereof. In a further embodiment, the heterologous protein is a monoclonal antibody (mAb) or an equivalent thereof, including but not limited to: a mAb or an equivalent thereof recognizing and binding to VEGFR (such as Avastin™), or a mAb or an equivalent thereof recognizing and binding to HER2 (such as Herceptin™), or a mAb or an equivalent thereof recognizing and binding to EGFR (such as Erbitux™) or a mAb or an equivalent thereof that regulates immune checkpoints (also broadly known as "checkpoint antibody"), such as one recognizing and binding to CTLA4 [for example Yervoy™ (ipilimumab)], or one recognizing and binding to PD-1 [for example Keytruda™ (pembrolizumab) and Opdivo™ (nivolumab)], or one recognizing and binding to PD-L1 (for example, Tecentriq™ (atezolizumab)]. In another embodiment, the heterologous protein is selected from the group of Granulocyte-macrophage colony-stimulating factor (GM-CSF) or an equivalent thereof, an interleukin such as IL-2 or IL-15, or an interferon such IFNβ or IFNγ; or a natural bioactive peptide, such as thymosin A or adiponectin, or a synthetic peptide such as hexarelin.

Hydrodynamic delivery has emerged as the simplest and most effective method for intracellular delivery of membrane impermeable substances in rodents. The system employs a physical force generated by a rapid injection of large volume of solution into a blood vessel to enhance the permeability of endothelium and the plasma membrane of the parenchyma cells to allow delivery of substance into cells. The procedure was initially established for gene delivery in mice and its applications have been extended to the delivery of proteins, oligo nucleotides, genomic DNA and RNA sequences, and small molecules. The advantage for the use of hydrodynamic gene delivery to study therapeutic functions of a gene is obvious. A candidate gene in plasmid or DNA fragment with regulatory sequence for its expression can be hydrodynamically injected into an animal (mouse or rat) carrying a target disease. The therapeutic effect of the gene product (protein or RNA) on disease progression or regression is then evaluated with time. Similar to a conventional drug study, repeated gene transfer, different amount of DNA, and different regiment can be used to maximize the therapeutic outcome. Compared to conventional biotech approach that relies on purified protein for therapeutic assessment, hydrodynamics-based protocol makes the liver as the manufacture site for therapeutic proteins, eliminating the steps and cost for protein production and characterization. In addition, since therapeutic evaluation is directly conducted in animals, no issues about formulation development and bioavailability need to be addressed. Examples of hydrodynamic gene delivery to treat disease include intra-arterial delivery of endostatin gene to brain tumors to prolong animal survival; high volume hydrodynamic injection of plasmid DNA via the hepatic artery leading to a high level of gene expression in rat hepatocellular carcinoma induced by diethylnitrosamine; therapeutic effects of intravenous interferon gene delivery with naked plasmid DNA in murine metastasis models and others (reviewed in Bonamassa et al, 2011; PMID: 21191634).

As used herein, the term "animal" refers to living multicellular vertebrate organisms, a category that includes, for example, mammals and birds. The term "mammal" includes both human and non-human mammals.

The terms "subject," "host," "individual," and "patient" are as used interchangeably herein to refer to human and veterinary subjects, for example, humans, animals, non-human primates, dogs, cats, sheep, mice, horses, and cows. In some embodiments, the subject is a human.

An "effective amount" or "efficacious amount" refers to the amount of an agent, or combined amounts of two or more agents, that, when administered for the treatment of a mammal or other subject, is sufficient to effect such treatment for the disease. The "effective amount" will vary depending on the agent(s), the disease and its severity and the age, weight, etc., of the subject to be treated.

As used herein, a biological sample, or a sample, can be obtained from a subject, cell line or cultured cell or tissue. Exemplary samples include, but are not limited to, cell sample, tissue sample, tumor biopsy, liquid samples such as blood and other liquid samples of biological origin (including, but not limited to, ocular fluids (aqueous and vitreous humor), peripheral blood, sera, plasma, ascites, urine, cerebrospinal fluid (CSF), sputum, saliva, bone marrow, synovial fluid, aqueous humor, amniotic fluid, cerumen, breast milk, broncheoalveolar lavage fluid, semen, prostatic fluid, cowper's fluid or pre-ejaculatory fluid, female ejaculate, sweat, tears, cyst fluid, pleural and peritoneal fluid, pericardial fluid, ascites, lymph, chyme, chyle, bile, interstitial fluid, menses, pus, sebum, vomit, vaginal secretions/flushing, synovial fluid, mucosal secretion, stool water, pancreatic juice, lavage fluids from sinus cavities, bronchopulmonary aspirates, blastocyl cavity fluid, or umbilical cord blood. In some instances, the sample is a tumor/cancer biopsy.

A "solid tumor" is an abnormal mass of tissue that usually does not contain cysts or liquid areas. Solid tumors can be benign or malignant. Different types of solid tumors are named for the type of cells that form them. Examples of solid tumors include sarcomas, carcinomas, and lymphomas. The solid tumor can be localized or metastatic.

As used herein, the term "extracellular matrix" (ECM) is a three-dimensional network of extracellular macromolecules, such as collagen, enzymes, and glycoproteins, that provide structural and biochemical support to surrounding cells. It is an essential component of the tumor microenvironment. Cancer development and progression are associated with increased ECM deposition and crosslink, while the chemical and physical signals elicited from ECM are necessary for cancer cell proliferation and invasion. In one embodiment, the ECM of a cancer comprises a peri-cancerous cell or tissue.

The pi3K pathway is an intracellular signal transduction pathway that promotes metabolism, proliferation, cell survival, growth and angiogenesis in response to extracellular signals. This is mediated through serine and/or threonine phosphorylation of a range of downstream substrates. Key proteins involved are phosphatidylinositol 3-kinase (PI3K) and Akt/Protein Kinase B.PTEN is a main down regulation protein which can convert PIP3 into PIP2. Addition to these regulation protein, the pathway itself also have feedback mechanisms: Transcription factor NF-κB, activated by Akt, regulates peroxisome proliferator-activated receptor delta (PPARβ/δ) agonists and tumor necrosis factor α (TNFα), which in turn repress PTEN expression as a positive feedback; Negative feedback loop is functioned by mTORC and S6K1 activation. S6K1 is able to phosphorylate IRS-1 at multiple serine residues, preventing binding to RTKs, resulting the suppression of PI3K activation.

As used herein, the term "detectable marker" refers to at least one marker capable of directly or indirectly, producing a detectable signal. A non-exhaustive list of this marker includes enzymes which produce a detectable signal, for example by colorimetry, fluorescence, luminescence, such as horseradish peroxidase, alkaline phosphatase, β-galactosidase, glucose6-phosphate dehydrogenase, chromophores such as fluorescent, luminescent dyes, groups with electron density detected by electron microscopy or by their electrical property such as conductivity, amperometry, voltammetry, impedance, detectable groups, for example whose molecules are of sufficient size to induce detectable modifications in their physical and/or chemical properties, such detection may be accomplished by optical methods such as diffraction, surface plasmon resonance, surface variation, the contact angle change or physical methods such as atomic force spectroscopy, tunnel effect, or radioactive molecules such as $^{32}P$, $^{35}S$ $^{89}Zr$ or $^{125}I$.

As used herein, the term "purification marker" refers to at least one marker useful for purification or identification. A non-exhaustive list of this marker includes His, lacZ, GST, maltose-binding protein, NusA, BCCP, c-myc, CaM, FLAG, GFP, YFP, cherry, thioredoxin, poly(NANP), V5, Snap, HA, chitin-binding protein, Softag 1, Softag 3, Strep, or S-protein. Suitable direct or indirect fluorescence marker comprise FLAG, GFP, YFP, RFP, dTomato, cherry, Cy3, Cy 5, Cy 5.5, Cy 7, DNP, AMCA, Biotin, Digoxigenin, Tamra, Texas Red, rhodamine, Alexa fluors, FITC, TRITC or any other fluorescent dye or hapten.

As used herein, an epitope tag is a biological structure or sequence, such as a protein or carbohydrate, which acts as an antigen that is recognized by an antibody. In certain embodiments, an epitope tag is used interchangeably with a purification marker and/or an affinity tag.

As used herein, "optical imaging" refers to imaging of a signal where at least some of the signal from the region of interest is in the form of an electromagnetic radiation in the visible light range. Non-limiting examples of optical imaging include detection of fluorescence and luminescence signals. Such signals can be captured by optical devices, such as a camera.

As used herein, "non-optical imaging" refers to imaging of a signal where at least some of the signal from the region of interest is in the form of electromagnetic radiation outside the visible range, and can include particles, and other propagations of energy. Non-limiting examples of non-optical imaging include detection of gamma rays (e.g., SPECT), X-rays, RF signals (e.g., MRI), particles such as electrons or positrons (e.g., PET), and other forms of energy propagations (e.g., ultrasound).

As used herein, "immunophenotyping" refers to the analysis of heterogeneous populations of cells for the purpose of identifying the presence and proportions of the various populations in the sample. Antibodies are used to identify cells by detecting specific antigens (termed markers) expressed by these cells. In an aspect, the cell samples are characterized by immunophenotyping using techniques such as flow cytometry. In alternative aspects, characterizations of the various cell types, (such as T cells, B cells and their subsets) present in a cell sample may be carried out using any suitable methodology such as reverse transcriptase polymerase chain reaction (RT-PCR) or immunocytochemistry (IHC). In an aspect, the populations of cells or cell types present in the cell sample are identified based on the presence or absence of one or more cell surface markers selected from CD45, CD3, CD4, CD8, FoxP3, CD25, Pd-1, CD69 (lag3/ICOS/CTLA4), Ki-67, CD49b/CD335, CD19, CD11b, Ly-6G, Ly-6C, CD11c, CD24, F4/80, MHC II, CD206, CD44, CD62L, CD103, XCR1, CD80, CD86, Siglec-H (15), CD115, PD-L1.

The phrase "first line" or "second line" or "third line" refers to the order of treatment received by a patient. First line therapy regimens are treatments given first, whereas second or third line therapy are given after the first line therapy or after the second line therapy, respectively. The National Cancer Institute defines first line therapy as "the first treatment for a disease or condition. In patients with cancer, primary treatment can be surgery, chemotherapy, radiation therapy, or a combination of these therapies. First line therapy is also referred to those skilled in the art as "primary therapy and primary treatment". Typically, a patient is given a subsequent chemotherapy regimen because the patient did not show a positive clinical or sub-clinical response to the first line therapy or the first line therapy has stopped.

It is to be inferred without explicit recitation and unless otherwise intended, that when the present disclosure relates to a polypeptide, protein, polynucleotide or antibody, an equivalent or a biologically equivalent of such is intended within the scope of this disclosure. As used herein, the term "biological equivalent thereof" is intended to be synonymous with "equivalent thereof" when referring to a reference protein, antibody, polypeptide or nucleic acid, intends those having minimal sequence identity while still maintaining desired structure or functionality. Unless specifically recited herein, it is contemplated that any polynucleotide, polypeptide or protein mentioned herein also includes equivalents thereof. For example, an equivalent intends at least about 70% homology or identity, or at least 80% homology or identity and alternatively, or at least about 85%, or alternatively at least about 90%, or alternatively at least about 95%, or alternatively 98% percent homology or identity across the length of the reference sequence and exhibits substantially equivalent biological activity to the reference protein, polypeptide or nucleic acid. Alternatively, when referring to polynucleotides, an equivalent thereof is a polynucleotide that hybridizes under stringent conditions to the reference polynucleotide or its complement.

A "composition" is intended to mean a combination of active polypeptide, polynucleotide or antibody and another compound or composition, inert (e.g., a detectable label) or active (e.g., a gene delivery vehicle).

A "pharmaceutical composition" is intended to include the combination of an active polypeptide, polynucleotide or antibody with a carrier, inert or active such as a solid support, making the composition suitable for diagnostic or therapeutic use in vitro, in vivo or ex vivo.

As used herein, the term "pharmaceutically acceptable carrier" encompasses any of the standard pharmaceutical carriers, such as a phosphate buffered saline solution, water, and emulsions, such as an oil/water or water/oil emulsion, and various types of wetting agents. The compositions also can include stabilizers and preservatives. For examples of carriers, stabilizers and adjuvants, see Martin (1975) Remington's Pharm. Sci., 15th Ed. (Mack Publ. Co., Easton).

A "subject" of diagnosis or treatment is a cell or an animal such as a mammal, or a human. A subject is not limited to a specific species and includes non-human animals subject to diagnosis or treatment and are those subject to infections or animal models, for example, simians, murines, such as, rats, mice, chinchilla, canine, such as dogs, leporids, such as rabbits, livestock, sport animals, and pets. Human patients are included within the term as well.

The term "tissue" is used herein to refer to tissue of a living or deceased organism or any tissue derived from or designed to mimic a living or deceased organism. The tissue may be healthy, diseased, and/or have genetic mutations. The biological tissue may include any single tissue (e.g., a collection of cells that may be interconnected) or a group of tissues making up an organ or part or region of the body of an organism. The tissue may comprise a homogeneous cellular material or it may be a composite structure such as that found in regions of the body including the thorax which for instance can include lung tissue, skeletal tissue, and/or muscle tissue. Exemplary tissues include, but are not limited to those derived from liver, lung, thyroid, skin, pancreas, blood vessels, bladder, kidneys, brain, biliary tree, duodenum, abdominal aorta, iliac vein, heart and intestines, including any combination thereof.

As used herein, "treating" or "treatment" of a disease in a subject refers to (1) preventing the symptoms or disease from occurring in a subject that is predisposed or does not yet display symptoms of the disease; (2) inhibiting the disease or arresting its development; or (3) ameliorating or causing regression of the disease or the symptoms of the disease. As understood in the art, "treatment" is an approach for obtaining beneficial or desired results, including clinical results. For the purposes of the present technology, beneficial or desired results can include one or more, but are not limited to, alleviation or amelioration of one or more symptoms, diminishment of extent of a condition (including a disease), stabilized (i.e., not worsening) state of a condition (including disease), delay or slowing of condition (including disease), progression, amelioration or palliation of the condition (including disease), states and remission (whether partial or total), whether detectable or undetectable. In one aspect, the term "treatment" excludes prevention.

As used herein, the term "efficacy" or "effectiveness" refers to the capacity of achieving a beneficial and/or desired result by a given intervention, such as contacting, administering and/or delivering one or more of a fusion protein, a polynucleotide, a vector, a composition or a method as disclosed herein. In one embodiment, the given intervention is an in vivo treatment of a subject. In another embodiment, the given intervention is performed/conducted ex vivo or in vitro, for example applied to an cancer cell or tissue isolated from a subject, or a cancer cell line. Non-limiting examples of a desired efficacy (which is also referred to as a therapeutic effect) include a successful treatment of a disease (for example, a cancer) in a subject, inhibition of a cancer cell growth in vivo, ex vivo or in vitro, and/or a change in biomarker. Various methods can be used for evaluating such efficacy including those disclosed in the examples. In certain embodiment, a desired efficacy may also include an increase of PTEN gene copy, PTEN mRNA, and/or PTEN protein in a cancer cell/tissue. Additionally or alternatively, a desired efficacy refers to an increase of (1) a PTEN protein, (2) a fragment, analogue, variant, mutant, isoform or equivalent of a PTEN protein, and/or (3) a fusion protein comprising (1) or (2) as described herein in a peri-cancerous area. The fusion protein of (3) may further comprise an amino acid sequence allowing its penetration into a cell (for example, a cancer cell), such as a serum albumin and/or a Minimal Cell Penetration Domain (MCPD) of a PTEN. The phrase "inhibiting a cancer cell growth" or any grammatical variation thereof, as used herein, refers to one or more of the following: inhibiting, arresting, metastasis, delaying and/or slowing down replication of the cancer cell, reducing the total number of the cancer cells, promoting cell death (such as apoptosis and necrosis) of the cancer cell, decreased expression of a cancer cell biomarker (such as an onco-miR, or a pi3K pathway pharmacodynamics biomarker), and/or presence or increased expression of a molecule lack or expressed at a low level in a cancer cell (such as PTEN).

MODES FOR CARRYING OUT THE DISCLOSURE

This disclosure provides a fusion protein comprising, or alternatively consisting essentially of, or yet further consisting of consecutive amino acid sequences of a serum albumin (SA), including but not limited to human serum albumin (HSA), simian serum albumin (SSA), rat serum albumin (RSA), mouse serum albumin (MSA), or a deletion mutant, variant or analog thereof and the human PTEN-L or PTEN tumor suppressor or a deletion mutant, variant or analog thereof. In one embodiment, the amino acid sequence of the serum albumin is conjugated directly or indirectly to the N-terminal of the PTEN. In another embodiment, the amino acid sequence of the serum albumin is conjugated directly or indirectly to the C-terminal of the PTEN.

In one aspect, the serum albumin is selected from the group of a human serum albumin (HSA), a simian serum albumin (SSA), a rat serum albumin (RSA), or a mouse serum albumin (MSA), or a fragment, analogue, variant, mutant, isoform or equivalent of each. In another embodiment, the serum albumin comprises, or consists essentially of, or yet further consists of an albumin domain I equivalent to amino acids 1-197 of SEQ ID NO:13. In a further embodiment, the serum albumin comprises, or consists essentially of, or yet further consists of domains I and II of an albumin equivalent to amino acids 1-395 of SEQ ID NO:13. In yet a further embodiment, the albumin lacks an albumin domain III equivalent to amino acids 382-585 of SEQ ID NO:13. In certain embodiments, the albumin lacks an albumin domain II equivalent to amino acids 198-381 of SEQ ID NO:13. In one embodiment, the albumin lacks an albumin domain II and III equivalent to amino acids 198-585 of SEQ ID NO:13. In another embodiment, the albumin lacks the first 34 or 62 amino acids of a mature HSA or an equivalent thereof. Optionally, the albumin comprises, or consists essentially of, or yet further consists of an amino acid sequence of amino acids 35-385 or 63-585 of SEQ ID NO:13 or an equivalent thereof. In one embodiment, the serum albumin is a pre-protein which comprises a signal peptide or a mature serum albumin which lacks a signal peptide. In a further embodiment, the serum albumin comprises a mutation at a position equivalent to amino acid 58 or SEQ ID NO:12 or amino acid 34 of SEQ ID NO:13, optionally from Cysteine to Serine, or an equivalent of each that retains the mutation at amino acid 34 of SEQ ID NO:13. Additionally or alternatively, the serum albumin comprises an amino acid conjugated with a molecule at a position equivalent to amino acid 34 of SEQ ID NO:13, and wherein the molecule is a small molecule, a cytotoxic molecule, a linker, a pH-sensitive linker, and/or a thiol linker.

In one embodiment, the serum albumin comprises, or consists essentially of, or yet further consists of an amino acid sequence selected from the group of: SEQ ID NOs:12-13, 90-93 and 163, or a fragment, analogue, variant, mutant, isoform or an equivalent of any one of SEQ ID NOs:12-13, 90-93 and 163 that has the same or similar activity as SEQ ID NOs:12, 13, 90-93, or 163, respectively. Additionally or alternatively, the serum albumin comprises, or consists essentially of, or yet further consists of an amino acid sequence encoded by an engineered polynucleotide sequence selected from the group of: SEQ ID NO:176-179, or a sequence at least 90% identical thereto which encodes the same amino acid sequence as encoded by SEQ ID NO:176-179.

In another embodiment, the SA portion of the fusion protein comprises, or consists essentially of, or yet further consists of the amino acid sequence of SEQ ID NO:12-13 (HSA) or SEQ ID NO:90 (SSA), or SEQ ID NO:91 (RSA) or SEQ ID NO:92 (MSA), or a deletion mutant thereof such as the Minimal Human Serum Albumin (SEQ ID NO:163) or an equivalent, or a fragment, or a minimal fragment, or an analogue, or a variant of each thereof.

In a further aspect, the PTEN is selected from the group of mammalian, e.g. human PTEN, simian PTEN, rat PTEN, or murine PTEN. In one embodiment, the PTEN is in its mature form which lacks a single peptide (for example, SEQ ID NO:3), or is a pre-protein (for example, SEQ ID NO:1).

In one embodiment, the PTEN comprises, or consists essentially of, or yet further consists of a PTEN-Long (PTEN-L), or a fragment, analogue, variant, mutant, or equivalent thereof. In a further embodiment, the PTEN-L is a human PTEN-L having an amino acid sequence of SEQ ID NO:3, additionally or alternatively, the PTEN-L is a human PTEN-L encoded by an engineered polynucleotide sequence of SEQ ID NO:171 or nucleotide (nt) 64-nt 1728 of SEQ ID NO:171, or a sequence at least 90% identical thereto which encodes the same amino acid sequence as encoded by SEQ ID NO:171 or nucleotide (nt) 64-nt 1728 of SEQ ID NO:171. In one embodiment, the PTEN comprises an amino acid sequence encoded by an engineered polynucleotide sequence selected from the group of: SEQ ID NO:171, nucleotide (nt) 64-nt 1728 of SEQ ID NO:171, or SEQ ID NO:167, or a fragment thereof, or a sequence at least 90% identical thereto which encodes the same amino acid sequence as the amino acid sequence encoded by SEQ ID NO:171, nt 64-nt 1728 of SEQ ID NO:171, or SEQ ID NO:167, respectively. In certain embodiments, the PTEN comprises, or consists essentially of, or yet further consists of an amino acid sequence selected from the group of: SEQ ID NO:1 or 3 or 89, or a fragment, analogue, variant, mutant, or equivalent thereof.

In one embodiment, the PTEN comprises, or consists essentially of, or yet further consists of an amino acid sequence of SEQ ID NO:6 or 201, or a fragment, analogue, variant, mutant, or equivalent of SEQ ID NO:6 or 201. Additionally or alternatively, the PTEN comprises an amino acid sequence encoded by an engineered polynucleotide sequence selected from the group of: SEQ ID NO:198 or 204, or a fragment thereof, or a sequence at least 90% identical thereto which encodes the same amino acid sequence as the amino acid sequence encoded by SEQ ID NO:198 or 204, respectively. In one embodiment, the PTEN is a PTEN-M isoform, or a fragment, analogue, variant, mutant, or equivalent thereof. In certain embodiments, the PTEN-M is a human PTEN-M having an amino acid sequence of SEQ ID NO:6. Additionally or alternatively, the PTEN-M is a human PTEN-M encoded by an engineered polynucleotide sequence of SEQ ID NO:198, or a sequence at least 90% identical thereto which encodes the same amino acid sequence as SEQ ID NO:6.

In another embodiment, the PTEN comprises, or consists essentially of, or yet further consists of an amino acid sequence of SEQ ID NO:7 or 202, or a fragment, analogue, variant, mutant, or equivalent of SEQ ID NO:7 or 202. Additionally or alternatively, the PTEN comprises, or consists essentially of, or yet further consists of an amino acid sequence encoded by an engineered polynucleotide sequence selected from the group of SEQ ID NO:199, or 205, or a fragment thereof, or a sequence at least 90% identical thereto which encodes the same amino acid sequence as the amino acid sequence encoded by SEQ ID NO:199, or 205, respectively. In certain embodiments, the PTEN is a PTEN-N isoform, or a fragment, analogue, variant, mutant, or equivalent thereof. In a further embodiment, the PTEN-N is a human PTEN-N having an amino acid sequence of SEQ ID NO:7. Additionally or alternatively, the PTEN-N is a human PTEN-N encoded by an engineered polynucleotide sequence of SEQ ID NO:199, or a sequence at least 90% identical thereto which encodes the same amino acid sequence as SEQ ID NO:7.

In yet another embodiment, the PTEN comprises, or consists essentially of, or yet further consists of an amino acid sequence of SEQ ID NO:8 or 203, or a fragment, analogue, variant, mutant, or equivalent of SEQ ID NO:8 or 203. Additionally or alternatively, the PTEN comprises, or consists essentially of, or yet further consists of an amino acid sequence encoded by an engineered polynucleotide sequence selected from the group of: SEQ ID NO:200 or 206, or a fragment thereof, or a sequence at least 90% identical thereto which encodes the same amino acid sequence as the amino acid sequence encoded by SEQ ID NO:200 or 206. In certain embodiments, the PTEN is a PTEN-O isoform, or a fragment, analogue, variant, mutant, or equivalent thereof. In a further embodiment, the PTEN-O is a human PTEN-O having an amino acid sequence of SEQ ID NO:8. Additionally or alternatively, the PTEN-O is a human PTEN-O encoded by an engineered polynucleotide sequence of SEQ ID NO:200, or a sequence at least 90% identical thereto which encodes the same amino acid sequence as SEQ ID NO:8.

In one embodiment, the PTEN comprises, or consists essentially of, or yet further consists of an amino acid sequence selected from the group of: SEQ ID NO:2 or 88, or a fragment, analogue, variant, mutant, or equivalent of SEQ ID NO:2 or 88. Additionally or alternatively, the PTEN comprises an amino acid sequence encoded by an engineered polynucleotide sequence selected from the group of: SEQ ID NO:172 or 166, or a fragment thereof, or a sequence at least 90% identical thereto which encodes the same amino acid sequence as the amino acid sequence encoded by SEQ ID NO:172 or 166, respectively. In certain embodiments, the PTEN comprises, or consists essentially of, or yet further consists of a PTEN-S, or a fragment, analogue, variant, mutant, or equivalent thereof. In a further embodiment, the PTEN is a PTEN-S, or a fragment, analogue, variant, mutant, or equivalent thereof. In certain embodiments, the fusion protein lacks a cleavable linker between the PTEN-S and the albumin.

In another embodiment, the PTEN comprises, or consists essentially of, or yet further consists of a minimal PTEN-S, or a fragment, analogue, variant, mutant, or equivalent thereof. In a further embodiment, the minimal PTEN-S comprises, or consists essentially of, or yet further consists of an amino acid sequence of SEQ ID NO:162. Additionally or alternatively, the minimal PTEN-S comprises, or consists essentially of, or yet further consists of an amino acid sequence encoded by the engineered polynucleotide sequence selected SEQ ID NO:197, or a sequence at least 90% identical thereto which encodes the same amino acid sequence as SEQ ID NO:162.

In another embodiment, the PTEN comprises, or consists essentially of, or yet further consists of any one or more of the following: a mature human PTEN-L Unique Domain (LUD), or a fragment, analogue, variant, mutant, or equivalent thereof, optionally wherein the LUD comprises, or consists essentially of, or yet further consists of an amino acid sequence of SEQ ID NO:5, further optionally wherein the LUD comprises, or consists essentially of, or yet further consists of an amino acid sequence encoded by the engineered polynucleotide sequence of SEQ ID NO:193, or a sequence at least 90% identical thereto which encodes the same amino acid sequence as SEQ ID NO:5, and optionally wherein the LUD is glycosylated; a human PTEN-M Unique Domain (MUD), or a fragment, analogue, variant, mutant, or equivalent thereof, optionally wherein the MUD comprises, or consists essentially of, or yet further consists of an amino acid sequence of SEQ ID NO:9, and/or further optionally wherein the MUD comprises, or consists essentially of, or yet further consists of an amino acid sequence encoded by the engineered polynucleotide sequence of SEQ ID NO:194, or a sequence at least 90% identical thereto which encodes the same amino acid sequence as SEQ ID NO:9, and optionally wherein the MUD is glycosylated; a human PTEN-N Unique Domain (NUD), or a fragment, analogue, variant, mutant, or equivalent thereof, optionally wherein the NUD comprises, or consists essentially of, or yet further consists of an amino acid sequence of SEQ ID NO:10, and/or further optionally wherein the NUD comprises, or consists essentially of, or yet further consists of an amino acid sequence encoded by the engineered polynucleotide sequence of SEQ ID NO:195, or a sequence at least 90% identical thereto which encodes the same amino acid sequence as SEQ ID NO:10, and optionally wherein the NUD is glycosylated; a human PTEN-O Unique Domain (OUD), or a fragment, analogue, variant, mutant, or equivalent thereof, optionally wherein the OUD comprises, or consists essentially of, or yet further consists of an amino acid sequence of SEQ ID NO:11, and/or further optionally wherein the OUD comprises, or consists essentially of, or yet further consists of an amino acid sequence encoded by the engineered polynucleotide sequence of SEQ ID NO:196, or a sequence at least 90% identical thereto which encodes the same amino acid sequence as SEQ ID NO:11, and optionally wherein the OUD is glycosylated; a minimal cell-penetration domain (MCPD) comprising an amino acid sequence of 6×Arg (SEQ ID NO:39), and optionally wherein the fusion protein comprises a cleavable linker between the PTEN and the albumin; a membrane-binding domain (MBD), optionally wherein the MBD comprises, or consists essentially of, or yet further consists of an amino acid sequence of SEQ ID NO:40; and a minimal PTEN-S, or a fragment, analogue, variant, mutant, or equivalent thereof, optionally wherein the minimal PTEN-S comprises, or consists essentially of, or yet further consists of an amino acid sequence of SEQ ID NO:162, and/or further optionally wherein the minimal PTEN-S comprises, or consists essentially of, or yet further consists of an amino acid sequence encoded by the engineered polynucleotide sequence of SEQ ID NO:197, or a sequence at least 90% identical thereto which encodes the same amino acid sequence as SEQ ID NO:162. In certain embodiments, one or more of the serine (S) and/or threonine (T) residues of the LUD, MUD, NUD, and/or OUD is O-glycosylated. Additionally or alternatively, one or more of asparagine (N) residues of the LUD, MUD, NUD, and/or OUD is N-glycosylated. In one embodiment the glycosylated residue(s) are at one or more of positions equivalent to the following: S65, S85, S89, S91, S94, S111, S115, S117, S129, S134, T140, S161, S163, S164 and S168 of SEQ ID NO:1 and/or S170, N292, S355, S360, S366 and S370 of SEQ ID NO:2. In certain embodiments, the glycosylated residue(s) are at one or more of positions equivalent to any one or more of the following: S115, S117, S129, S134, T140, S161, S163, S164 and S168 of SEQ ID NO: 1 or an equivalent thereof that retains these mutated amino acids. In a further embodiment, the glycosylated residue(s) are at one or more of positions equivalent to any one or more of the following: S115, S117, S163, S164 and S168 of SEQ ID NO: 1 or an equivalent thereof that retains these mutated amino acids.

In a further embodiment, the fusion protein further comprises one or more mutations selected a position equivalent to any one or more of the following: S65, S85, S89, S91, S94, S111, S115, S117, S129, S134, T140, S161, S163, S164 and S168 of SEQ ID NO:1 and/or S170, N292, S355, S360, S366 and S370 of SEQ ID NO:2. In certain embodiments, the fusion protein further comprises one or more mutations selected a position equivalent to any one or more of the following: S115, S117, S129, S134, T140, S161, S163, S164 and S168 of SEQ ID NO: 1 or an equivalent thereof that retains these mutated amino acids. In a further embodiment, the fusion protein further comprises one or more mutations selected a position equivalent to any one or more of the following: S115, S117, S163, S164 and S168 of SEQ ID NO: 1 or an equivalent thereof that retains these mutated amino acids. In yet a further embodiment, the amino acid is mutated to an aspartate or a glutamate.

In another embodiment, the PTEN comprises amino acids 174 to 576 of SEQ ID NO:1 and one or more of the following: amino acids 22-27, 44-59, 43-79, 80-120, 121-173 and/or 151-173 of SEQ ID NO:1. In one embodiment, the PTEN comprises amino acids 121-173 of SEQ ID NO:1 or an equivalent thereof. In a further embodiment, the PTEN comprises amino acids 121-173 of SEQ ID NO:1 and PTEN-S or an equivalent thereof. In a further embodiment, the PTEN comprises an amino acid sequence of SEQ ID NO: 25 or an equivalent thereof. In another embodiment, the PTEN comprises an amino acid sequence of SEQ ID NO: 50 or an equivalent thereof.

In one embodiment, the PTEN portion of the fusion protein comprises, or consists essentially of, or yet further consists of, the amino acid sequence of SEQ ID NO:1, 2, 3, 6, 7, 8, 88, 89, 134 or 162, or an equivalent, or a fragment, or a minimal fragment, or an analogue, or a variant of each.

In one embodiment, the fusion protein further comprises a signal peptide. In a further embodiment, the signal peptide is at the N-terminal of the fusion protein for secretion. In yet a further embodiment, the signal peptide is selected from the group of: an HSA signal peptide, an SSA signal peptide, an RSA signal peptide, an MSA signal peptide, a signal peptide of murine α2-macroglobulin, a murine fibrinogen signal peptide, a murine α1-antitrypsin signal peptide, a murine IgGκ chain signal peptide, a human IgG heavy chain signal peptide, a human CD33 signal peptide, or an artificial signal peptide. In certain embodiments, the signal peptide comprises, or consists essentially of, or yet further consists of an amino acid sequence selected from the group of SEQ ID NOs:93-105. In one embodiment, the signal peptide is encoded by an engineered polynucleotide sequence selected from the group of: SEQ ID NOs:180-192, or a sequence at least 90% identical thereto which encodes the same amino acid sequence as SEQ ID NOs:93-105, respectively.

In one embodiment, the fusion protein further comprises a linker. In a further embodiment, the fusion protein comprises one or more of the following: a first linker between the albumin and the PTEN, a second linker at the C-terminal of the signal peptide and a third linker at the N-terminal of the fusion protein, and optionally wherein one or more of the linkers are cleavable. In one embodiment, the linker is cleavable by a protease present in a peri-cancerous cell or tissue. Non-limiting examples of the protease include MMP2, MMP9 or Cathepsin B. In a further embodiment, the linker comprises, or consists essentially of, or yet further consists of an amino acid sequence selected from the group of: SEQ ID NOs:164-165 and 106-108. In another embodiment, the linker and/or the fusion protein is cleavable by an intracellular protease, for example, a furin or a furin-like protease, or cathepsin B protease. In certain embodiments, the linker comprises, or consists essentially of, or yet further consists of an amino acid sequence selected from the group of SEQ ID NOs:48 or 106-108, and/or the PTEN comprises a Minimal Cell Penetration Domain (MCPD).

In one embodiment, the protease is selected from the group of ADAM8, ADAM9, ADAM10, ADAM12, ADAM15, ADAM17/TACE, ADAMDEC1, ADAMTS1, ADAMTS4, ADAMTS5, Aspartate proteases, e.g., BACE, Renin, Aspartic cathepsins, e.g., Cathepsin D, Cathepsin E, Caspases, e.g., Caspase 1, Caspase 2, Caspase 3, Caspase 4, Caspase 5, Caspase 6, Caspase 7, Caspase 8, Caspase 9, Caspase 10, Caspase 14, Cysteine cathepsins, e.g., Cathepsin B, Cathepsin C, Cathepsin K, Cathepsin L, Cathepsin S, Cathepsin V/L2, Cathepsin X/Z/P, Cysteine proteinases, e.g., Cruzipain, Legumain, Otubain-2, KLKs, e.g., KLK4, KLK5, KLK6, KLK7, KLK8, KLK10, KLK11, KLK13, KLK14, Metallo proteinases, e.g., Meprin, Neprilysin, PSMA, BMP-1, MMPs, e.g., MMP1, MMP3, MMP7, MMP8, MMP10, MMP11, MMP12, MMP13, MMP14, MMP15, MMP16, MMP17, MMP19, MMP20, MMP23, MMP24, MMP26, MMP27, Serine proteases, e.g., activated protein C, Cathepsin A, Cathepsin G, Chymase, coagulation factor proteases, (e.g., FVIIa, FIXa, FXa, FXIa, FXIIa), Elastase, Granzyme B, Guanidinobenzoatase, HtrAl, Human Neutrophil Elastase, Lactoferrin, Marapsin, NS3/4A, PACE4, Plasmin, PSA, tPA, Thrombin, Tryptase, uPA, Type II Transmembrane, Serine Proteases (TTSPs), e.g., DESC1, DPP-4, FAP, Hepsin, Matriptase-2, MT-SP1/Matriptase, TMPRSS2, TMPRSS3 or TMPRSS4.

In one embodiment, the fusion protein further comprises one or more of purification or detectable marker, for example, a 6×His tag (SEQ ID NO: 222), a hemagglutinin (HA) tag, a flag tag, or any other epitope tag. In a further embodiment, one or more markers are at the C-terminal of the fusion protein and/or one or more markers are between the albumin and the PTEN.

Further provided are fusion proteins that comprise, or consist essentially of, or yet further consist of the amino acid sequence of SEQ ID NO:18, 19, 24, 25, or 164-171 or an equivalent, or a fragment, or a minimal fragment, or an analogue, or a variant of each thereof. Yet further provided are fusion proteins that comprise, or consist essentially of, or yet further consists of the amino acid sequence of SEQ ID NOs:28, 117-132 or a fragment, analogue or variant thereof, or an equivalent of each. Also provided is a fusion protein comprising, or consisting essentially of, or yet further consisting of an amino acid sequence selected from the group of: SEQ ID NOs:14-37, 49-50, or 109-132 or a fragment, analogue, variant, mutant, or equivalent of each of SEQ ID NOs:14-37, 49-50, or 109-132. Additionally or alternatively, the fusion protein comprises, or consists essentially of, or yet further consists of an amino acid sequence encoded by an engineered polynucleotide sequence selected from the group of: SEQ ID NOs:54-77 or 135-160 or a fragment thereof, or a sequence at least 90% identical thereto which encodes the same amino acid sequence as SEQ ID NOs:54-77 or 135-160 respectively.

In another embodiment, provided is an N'-albumin-PTEN-C' fusion protein, for example, PR1 (SEQ ID NO:14; cDNA, 5'-albumin-PTEN-3', SEQ ID NO:54), PR2 (SEQ ID NO:15; cDNA, 5'-albumin-PTEN-3', SEQ ID NO:55), PR3 (SEQ ID NO:16; cDNA, 5'-albumin-PTEN-3', SEQ ID NO:56), PR5 (SEQ ID NO:17; cDNA, 5'-albumin-PTEN-3', SEQ ID NO:57), PR63 (SEQ ID NO:21; cDNA, 5'-albumin-PTEN-3', SEQ ID NO:61), PR64 (SEQ ID NO:22; cDNA, 5'-albumin-PTEN-3', SEQ ID NO:62), PR31 (SEQ ID NO:23; cDNA, 5'-albumin-PTEN-3', SEQ ID NO:63), PR32 (SEQ ID NO:24; cDNA, 5'-albumin-PTEN-3', SEQ ID NO:64), PR33 (SEQ ID NO:25; cDNA, 5'-albumin-PTEN-3', SEQ ID NO:65), PR34 (SEQ ID NO:50; cDNA, 5'-albumin-PTEN-3', SEQ ID NO:136). In another embodiment, provided is an N'-PTEN-L-albumin-C' fusion protein, for example, PR4 (SEQ ID NO:26; cDNA, 5'-PTEN-L-albumin-3', SEQ ID NO:66), PR401 (SEQ ID NO:27; cDNA, 5'-PTEN-L-albumin-3', SEQ ID NO:67), PR402 (SEQ ID NO:28; cDNA, 5'-PTEN-L-albumin-3', SEQ ID NO:68), PR403 (SEQ ID NO:29; cDNA, 5'-PTEN-L-albumin-3', SEQ ID NO:69), PR404 (SEQ ID NO:30; cDNA, 5'-PTEN-L-albumin-3', SEQ ID NO:70). In a further embodiment, created is a fusion protein comprising a N' terminal minimal PTEN domain and a C' terminal albumin. In yet a further embodiment, the minimal PTEN domain comprises an amino acid sequence of SEQ ID NO: 162. Additionally or alternatively, the albumin is an HSA and the fusion protein further comprises an HSA signal peptide and a 6×His tag (SEQ ID NO: 222). In another embodiment, provided is an N'-PTEN-L-albumin-C' fusion protein, for example, PR419 (SEQ ID NO:109; cDNA, 5'-PTEN-L-albumin-3', SEQ ID NO:137), PR420 (SEQ ID NO:110; cDNA, 5'-PTEN-L-albumin-3', SEQ ID NO:138), PR421 (SEQ ID NO:111; cDNA, 5'-PTEN-L-albumin-3', SEQ ID NO:139), PR422 (SEQ ID NO:112; cDNA, 5'-PTEN-L-albumin-3', SEQ ID NO:140), PR424 (SEQ ID NO:113; cDNA, 5'-PTEN-L-albumin-3', SEQ ID NO:141), PR425 (SEQ ID NO:114; cDNA, 5'-PTEN-L-albumin-3', SEQ ID NO:142), PR426 (SEQ ID NO:115; cDNA, 5'-PTEN-L-albumin-3', SEQ ID NO:143), PR427 (SEQ ID NO:116; cDNA, 5'-PTEN-L-albumin-3', SEQ ID NO:144), PR428 (SEQ ID NO:117; cDNA, 5'-PTEN-L-albumin-3', SEQ ID NO:145), PR409 (SEQ ID NO:118; cDNA, 5'-PTEN-L-albumin-3', SEQ ID NO:146), PR415 (SEQ ID NO:119; cDNA, 5'-PTEN-L-albumin-3', SEQ ID NO:147), PR416 (SEQ ID NO:120; cDNA, 5'-PTEN-L-albumin-3', SEQ ID NO:148), PR413 (SEQ ID NO:121; cDNA, 5'-PTEN-L-albumin-3', SEQ ID NO:149), PR414 (SEQ ID NO:122; cDNA, 5'-PTEN-L-albumin-3', SEQ ID NO:150), PR417 (SEQ ID NO:123; cDNA, 5'-PTEN-L-albumin-3', SEQ ID NO:151), and PR418 (SEQ ID NO:124; cDNA, 5'-PTEN-L-albumin-3', SEQ ID NO:152). In another embodiment, provided is an N'-albumin-PTEN-C' fusion protein, for example, PR6 (SEQ ID NO:18; cDNA, 5'-albumin-PTEN-3', SEQ ID NO:58), PR61 (SEQ ID NO:19; cDNA, 5'-albumin-PTEN-3', SEQ ID NO:59), PR62 (SEQ ID NO:20; cDNA, 5'-albumin-PTEN-3', SEQ ID NO:60), PR66 (SEQ ID NO:126; cDNA, 5'-albumin-PTEN-3', SEQ ID NO:154), PR67 (SEQ ID NO:127; cDNA, 5'-albumin-PTEN-3', SEQ ID NO:155) and PR68 (SEQ ID NO:128; cDNA, 5'-albumin-PTEN-3', SEQ ID NO:156). In another embodiment, provided is an N'-PTEN-S-albumin-C' fusion protein, for example, PR65 (SEQ ID NO:125; cDNA, 5'-PTEN-S-albumin-3', SEQ ID NO:153). In another embodiment, provided is an N'-PTEN-S-albumin-PTEN-S-C' fusion protein, for example, PR911 (SEQ ID NO:37; cDNA, 5'-PTEN-S-albumin-PTEN-S-3', SEQ ID NO:77). In another embodiment, provided is an N'-PTEN-L-albumin-C' fusion protein, for example, PR405 (SEQ ID NO:129; cDNA, 5'-PTEN-L-albumin-3', SEQ ID NO:157), PR406 (SEQ ID NO:130; cDNA, 5'-PTEN-L-albumin-3', SEQ ID NO:158), PR407 (SEQ ID NO:131; cDNA, 5'-PTEN-L-albumin-3', SEQ ID NO:159) and PR408 (SEQ ID NO:132; cDNA, 5'-PTEN-L-albumin-3', SEQ ID NO:160). In a further embodiment, provided is a fusion protein comprising a N' terminal albumin and a C' terminal minimal PTEN domain. In yet a further embodiment, the minimal PTEN domain comprises an amino acid sequence of SEQ ID NO: 162. Additionally or alternatively, the albumin is an HSA and the fusion protein further comprises an HSA signal peptide and a 6×His tag (SEQ ID NO: 222).

In another embodiment, provided is an N'-albumin-LUD-p53-C' fusion protein, for example, F131 (SEQ ID NO:38; cDNA SEQ ID NO:78). In another embodiment, provided is an N'-LUD-p53-albumin-C' fusion, for example, F137 (SEQ ID NO:133; cDNA SEQ ID NO:161).

In certain embodiments, the albumin is replaced with a Fe or a thioredoxin. In one embodiment, provided is an N'-PTEN-L-Fc-C' fusion protein, for example, PR7 (SEQ ID NO:34; cDNA, 5'-PTEN-L-Fc-3', SEQ ID NO:74), PR700 (SEQ ID NO:35; cDNA, 5'-PTEN-L-Fc-3', SEQ ID NO:75). In another embodiment, provided is an N'-Fc-PTEN-L-C' fusion protein, for example, PR8 (SEQ ID NO:36; cDNA, 5'-Fc-PTEN-L-3', SEQ ID NO:76). In another embodiment, provided is an N'-Thioredoxin-PTEN-L-C' fusion protein: PR430 (SEQ ID NO:49; cDNA, 5'-Thioredoxin-PTEN-L-3', SEQ ID NO:135).

In yet another embodiment, provided is a fusion protein comprising an amino acid sequence selected from SEQ ID NO: 14-30, 34-37, 49-50 and 109-132. In a further embodiment, the protein further comprises an N-terminal signal peptide, for example, encoded by a sequence selected from [nt(1-63) of SEQ ID NO: 171 or SEQ ID NO: 180-192]. In yet another embodiment, the fusion protein lacks signal peptide but comprises an initiator methionine residue (optionally encoded by ATG) is placed at the N terminal of either albumin or PTEN, respectively, as appropriate. In another embodiment, the fusion protein lacks signal peptide but comprises an initiator methionine (optionally encoded by ATG) replacing the first residue of albumin (for example, a mature albumin) or of PTEN [for example, a mature PTEN-L]. In another embodiment, the polynucleotide comprises one or more of SEQ ID NO:54-70, 74-77 or 135-160.

In one aspect, the proteins, fusion proteins, fragments, analogues, or variants thereof further comprise, or consist essentially of, or yet further consist of a detectable or purification label, examples of such are known in the art and briefly described herein.

Polynucleotides

Further provided are isolated and/or engineered polynucleotides encoding a fusion protein of this disclosure, as well as vectors and host cell systems comprising a polynucleotide (for example, one or more of the polynucleotide). In one embodiment, the isolated and/or engineered polynucleotides, vectors or host cells further comprises a detectable or purification marker.

In one aspect the polynucleotides are sequence-optimized (e.g. SEQ ID NO:41-47; 54-78, 86, 135-161, 166-167, 171-172, 176-200, and 204-206), for example, for high efficiency of gene expression in the host cell, including but not limited to: Codon usage bias, GC content, CpG dinucleotides content, mRNA secondary structure, cryptic splicing sites, premature polyA sites, internal chi sites and ribosomal binding sites, negative CpG islands, RNA instability motif (ARE), repeat sequences (direct repeat, reverse repeat, and dyad repeat), restriction sites that may interfere with cloning, a strong Kozak sequence and introduction of strong termination codons. Various algorithms and tools are available for performing such codon optimization, such as OptimumGene™.

In one embodiment, the polynucleotide comprises, or alternatively consists essentially of, or yet further consists of an engineered polynucleotide sequence selected from the group of: SEQ ID NOs: 54-70, 74-77, 135-160 or a fragment thereof. In a further embodiment, the polynucleotide comprises, or alternatively consists essentially of, or yet further consists of a polynucleotide at least 90% identical to any one of SEQ ID NOs: 54-70, 74-77, 135-160 and encoding the same amino acid sequence as SEQ ID NOs: 54-70, 74-77, 135-160, respectively. In one embodiment, the polynucleotide comprises, or alternatively consists essentially of, or yet further consists of an engineered polynucleotide sequence selected from the group of: SEQ ID NOs: 68, 59, 58, 157, 159, 65, or 136, or a fragment thereof. In a further embodiment, the polynucleotide comprises, or alternatively consists essentially of, or yet further consists of a polynucleotide at least 90% identical to any one of SEQ ID NOs: 68, 59, 58, 157, 159, 65, or 136 and encoding the same amino acid sequence as SEQ ID NOs: 68, 59, 58, 157, 159, 65, or 136, respectively.

Additionally or alternatively, the engineered polynucleotide sequence comprises, or alternatively consists essentially of, or yet further consists of an engineered polynucleotide sequence selected from the group of: SEQ ID NOs: 176-179, or a polynucleotide sequence at least 90% identical thereto which encodes the same amino acid sequence as encoded by SEQ ID NOs:176-179.

In certain embodiments, the engineered polynucleotide sequence comprises, or alternatively consists essentially of, or yet further consists of an engineered polynucleotide sequence selected from the group of: SEQ ID NOs: 166-172, 193-200, or 204-206, or a polynucleotide sequence at least 90% identical thereto which encodes the same amino acid sequence as encoded by SEQ ID NOs: 166-172, 193-200, or 204-206.

In certain embodiments, the engineered polynucleotide sequence comprises, or alternatively consists essentially of, or yet further consists of an engineered polynucleotide sequence selected from the group of: SEQ ID NOs: 180-192, or a polynucleotide sequence at least 90% identical thereto which encodes the same amino acid sequence as encoded by SEQ ID NOs: 180-192.

In certain embodiments, the engineered polynucleotide sequence comprises, or alternatively consists essentially of, or yet further consists of one or more engineered polynucleotides selected from any polynucleotides as summarized in Table 1 and listed herein, or a polynucleotide sequence at least 90% identical thereto which encodes the same amino acid sequence.

In one aspect, the polynucleotides further comprise polynucleotides that encode cell penetrating domains (e.g., SEQ ID NO:168-170). In another aspect, the polynucleotides further comprise polynucleotides encoding for secretory peptides, allowing for the secretion of the pre-protein into the culture supernatant following cleavage of the secretory peptide (e.g., SEQ ID NO:93-105). In a further aspect the polynucleotides are operatively linked to promoters, enhancers, introns, polyadenylation signals or other regulatory polynucleotides for the expression of the polynucleotides in host cell systems. In one embodiment, the regulatory sequences are suitable for used in a vector (viral or non-viral). In one embodiment, the regulatory sequences are tumor-specific, for example, an AFP promoter specific for hepatocellular carcinoma, a CCKAR promoter specific for pancreatic cancer, a CEA promoter specific for epithelial cancer, a c-erbB2 promoter specific for breast and pancreas cancer, a COX-2 promoter, a CXCR4 promoter, an E2F-1 promoter, a HE2 promoter, a LP promoter, a MUC1 promoter, a PSA promoter specific for prostate cancer, a survivin promoter, a TRP1 promoter specific for melanoma, a Tyr promoter specific for melanoma, an AFP/hAFP promoter specific for hepatocellular carcinoma, a SV40/AFP promoter specific for hepatocellular carcinoma, a CEA/CEA promoter specific for epithelial cancer, a PSA/PSA promoter specific for prostate cancer, or a SV40/Tyr promoter specific for melanoma. Non-limiting examples of such polynucleotides include a double-strand DNA, a single-strand DNA, a RNA (for example an mRNA), or a hybrid thereof. In a further embodiment, the polynucleotide is an mRNA suitable for use in an mRNA therapy.

In certain embodiments, the polynucleotide further comprises or encodes a short hairpin RNA, or a small hairpin RNA. Such secondary structure of RNA can guide RNA folding, determine interactions in a ribozyme, protect mRNA from degradation, serve as a recognition motif for RNA-binding protein, and also regulate gene expression. Additionally or alternatively, the short hairpin RNA may be processed into small interfering RNAs (siRNA), for example suitable for use in treating a cancer. See, e.g., Mahmoodi Chalbatani G et al, 2019: PMID: 31118626.

Aspects of the disclosure relate to a vector comprising one or more of the isolated polynucleotides or nucleic acids described above. In one embodiment, the vector comprises, or alternatively consists essentially of, or yet further consists of an engineered polynucleotide sequence selected from the group of: SEQ ID NOs: 54-70, 74-77, 135-160 or a fragment thereof. In a further embodiment, the vector comprises, or alternatively consists essentially of, or yet further consists of a polynucleotide at least 90% identical to any one of SEQ ID NOs: 54-70, 74-77, 135-160 and encoding the same amino acid sequence as SEQ ID NOs: 54-70, 74-77, 135-160, respectively. In another embodiment, the vector comprises, or alternatively consists essentially of, or yet further consists of an engineered polynucleotide sequence selected from the group of: SEQ ID NOs: 68, 59, 58, 157, 159, 65, or 136, or a fragment thereof. In a further embodiment, the vector comprises, or alternatively consists essentially of, or yet further consists of a polynucleotide at least 90% identical to any one of SEQ ID NOs: 68, 59, 58, 157, 159, 65, or 136 and encoding the same amino acid sequence as SEQ ID NOs: 68, 59, 58, 157, 159, 65, or 136, respectively. In yet a further embodiment, the vector further comprises a polynucleotide encoding a heterologous protein as described herein. In one embodiment, the vector further comprises an engineered polynucleotide sequence selected from SEQ ID NOs: 74 to 77 and 161, or a polynucleotide at least 90% identical to any one of SEQ ID NOs: 74 to 77 and 161 and encoding the same amino acid sequence as encoded by SEQ ID NOs: 74 to 77 and 161, respectively.

In one embodiment, the vector comprises, or alternatively consists essentially of, or yet further consists of an engineered polynucleotide sequence selected from the group of: SEQ ID NOs: 54-70, 74-77, 135-160 or a fragment thereof. In a further embodiment, the vector comprises, or alternatively consists essentially of, or yet further consists of a polynucleotide at least 90% identical to any one of SEQ ID NOs: 54-70, 74-77, 135-160 and encoding the same amino acid sequence as SEQ ID NOs: 54-70, 74-77, 135-160, respectively. In one embodiment, the vector comprises, or alternatively consists essentially of, or yet further consists of an engineered polynucleotide sequence selected from the group of: SEQ ID NOs: 68, 59, 58, 157, 159, 65, or 136, or a fragment thereof. In a further embodiment, the vector comprises, or alternatively consists essentially of, or yet further consists of a polynucleotide at least 90% identical to any one of SEQ ID NOs: 68, 59, 58, 157, 159, 65, or 136 and encoding the same amino acid sequence as SEQ ID NOs: 68, 59, 58, 157, 159, 65, or 136, respectively.

Additionally or alternatively, the vector comprises, or alternatively consists essentially of, or yet further consists of an engineered polynucleotide sequence selected from the group of: SEQ ID NOs:176-179, or a polynucleotide sequence at least 90% identical thereto which encodes the same amino acid sequence as encoded by SEQ ID NOs: 176-179.

In certain embodiments, the vector comprises, or alternatively consists essentially of, or yet further consists of an engineered polynucleotide sequence selected from the group of: SEQ ID NOs: 166-172, 193-200, or 204-206, or a polynucleotide sequence at least 90% identical thereto which encodes the same amino acid sequence as encoded by SEQ ID NOs: 166-172, 193-200, or 204-206.

In certain embodiments, the vector comprises, or alternatively consists essentially of, or yet further consists of an engineered polynucleotide sequence selected from the group of: SEQ ID NOs: 180-192, or a polynucleotide sequence at least 90% identical thereto which encodes the same amino acid sequence as encoded by SEQ ID NOs: 180-192.

In certain embodiments, the vector comprises, or alternatively consists essentially of, or yet further consists of one or more engineered polynucleotides selected from any polynucleotides as summarized in Table 1 and listed herein, or a polynucleotide sequence at least 90% identical thereto which encodes the same amino acid sequence.

In certain embodiments, the vector is a plasmid or a viral vector selected from the group of a retroviral vector, a lentiviral vector, an adenoviral vector, and an adeno-associated viral vector (AAV). In one embodiment, the vector is a viral vector. In a further embodiment, the vector is selected from the group of: rabies virus, flavivirus, lentivirus, baculovirus, retroviral vectors, adenovirus vectors (AdV), adeno-associated virus vectors (AAV), herpes simplex virus vectors (HSV), alphavirus vectors, Seneca Valley virus, poliovirus, vaccinia virus, reovirus, Coxsackievirus, parvovirus, Newcastle disease virus, vesicular stomatitis virus, measles virus, or infectious tobacco mosaic virus (TMV). In another embodiment, the vector is a non-viral vector. In a further embodiment, the vector is selected from the group of: liposomes, cationic lipid, micelles biocompatible polymers, including natural polymers and synthetic polymers; nanoparticles; lipoproteins; polypeptides; polysaccharides; lipopolysaccharides; metal particles; bacteria, bacteriophage, cosmid, plasmid, a yeast artificial chromosome, or fungal vectors. In yet a further embodiment, the plasmid is selected from the group of a pSIP609 *L plantarum* expression vector, a *Pichia pastoris* expression vector, or a mammalian expression vector. Non-limiting examples of such vectors that were used herein include the pSIP609 *L plantarum* expression vector (Sak-Ubol et al, 2016; PMID: 27176608) (disclosed as SEQ ID NO:174), a *Pichia pastoris* expression vector (SEQ ID NO:175), and a mammalian expression vector (pTT5, SEQ ID NO:173; FIG. 6C). In a further embodiment, provided is an expression vector further comprising a polynucleotide as disclosed herein. In yet a further embodiment, the vector comprises a nucleotide sequence of SEQ ID NO: 173 with the nucleotide residues between the restriction enzyme cut sites of EcoRI and HindIII in SEQ ID NO: 173 replaced with a polynucleotide as disclosed herein (such as a polynucleotide having a sequence selected from SEDQ ID NOs: 68, 59, 58, 157, 159, 65 or 136) or an equivalent thereof that retains these mutated amino acids. In certain embodiments, the plasmid comprises a sequence selected from the group of SEQ ID NOs:173-175. In certain embodiments, the vector comprises a sequence of SEQ ID NO:210, 211 or a fragment thereof. In one embodiment, the plasmid is a pAd(dps)ΔCU-IRES-E1A having a sequence of SEQ ID NO:211 or a fragment thereof which further comprises a polynucleotide encoding a fusion protein as disclosed herein. In another embodiment, the plasmid is a pAdEasy-1 having a sequence of SEQ ID NO:210 or a fragment thereof which further comprises a polynucleotide encoding a fusion protein as disclosed herein. In a further embodiment, provided is an rAdV vector produced using one or more of the plasmids as disclosed herein.

In aspects where gene transfer is mediated by a DNA viral vector, such as an adenovirus (AdV), herpes simplex virus (HSV) or adeno-associated virus (AAV), the vector comprises a viral genome or a fragment thereof, and a polynucleotide encoding for a protein of interest, such as the albumin-PTEN protein fusions disclosed herein. In certain embodiments, the protein of interest comprises an amino acid sequence selected from SEQ ID NO: 14-30, 34-37, 49-50 and 109-132. In another embodiment, the polynucleotide comprises an N-terminal signal peptide coding sequence selected of [nt(1-63) of SEQ ID NO: 171 or SEQ ID NO: 180-192]. In yet another embodiment, the fusion protein lacks signal peptide but comprises an initiator methionine residue (optionally encoded by ATG) is placed at the N terminal of either albumin or PTEN, respectively, as appropriate. In another embodiment, the fusion protein lacks signal peptide but comprises an initiator methionine (optionally encoded by ATG) replacing the first residue of albumin (for example, a mature albumin, optionally via replacing the first three nucleotides of an albumin coding polynucleotide with ATG, and further optionally the albumin coding polynucleotide is selected from SEQ ID NO:176-179) or of PTEN [for example, a mature PTEN-L, optionally via replacing the first three nucleotides of a PTEN coding polynucleotide with ATG, and further optionally the PTEN coding polynucleotide is selected from SEQ ID NO:167 or nucleotide (nt) 64-nt 1728 of SEQ ID NO:171]. In another embodiment, the polynucleotide comprises one or more of SEQ ID NO:54-70, 74-77, or 135-160.

In certain embodiments, the recombinant viral vector (such as an oncolytic HSV virus, an AdV or an AdV that encodes more than one polypeptide (e.g., a double Ad vector) or any other vector as disclosed herein further comprises a polynucleotide encoding a fusion protein. In a further embodiment, the polynucleotide is selected from SEQ ID NO:54-70, 74-77, or 135-160. Additionally or alternatively, the vector comprises a polynucleotide encoding a further protein which comprises an amino acid sequence of an albumin and an amino acid sequence of a p53 protein. As used herein, the fusion protein comprising the amino acid sequences of albumin and p53 protein is referred to herein as an albumin-p53 protein. In a further embodiment, the polynucleotide encoding an albumin-p53 protein is selected from SEQ ID NO:78 or 161. In certain embodiments, the recombinant viral vector and/or any vector as described herein further comprises a polynucleotide encoding all or a portion of a heterologous protein or polypeptide.

In one embodiment, the heterologous protein is heterologous to the vector. In a further embodiment, the heterologous protein is heterologous to the fusion protein, such as heterologous to human if the PTEN and/or albumin is a human one. In yet a further embodiment, the heterologous protein is a non-naturally occurring protein. In one embodiment, the heterologous protein comprises, or consists essentially of, or yet further consists of a PTEN or a fragment, analogue, variant, mutant, isoform or equivalent thereof. In one embodiment, the heterologous protein further comprises a signal peptide and/or a detectable or purification marker. In one embodiment, the heterologous protein lacks an amino acid sequence of albumin. In a further embodiment, the heterologous protein comprises, or consists essentially of, or yet further consists of a PTEN-L or a fragment, analogue, variant, mutant, isoform or equivalent thereof. In yet a further embodiment, the heterologous protein comprises an amino acid sequence selected from SEQ ID NOs: 31 to 33 or a fragment, analogue, variant, mutant, isoform or equivalent of each. In one embodiment, the heterologous protein is encoded by a polynucleotide comprising a sequence selected from SEQ ID NOs: 71-73, 171-72, 166-167, 198-200, 204-206, a fragment thereof, or a polynucleotide at least 90% identical to SEQ ID NOs: 71-73, 171-72, 166-167, 198-200, 204-206 and encoding the same amino acid sequence as encoded by SEQ ID NOs: 71-73, 171-72, 166-167, 198-200, 204-206, respectively. In one embodiment, the heterologous protein can be used in treating a cancer, such as an antibody or a fragment thereof. In a further embodiment, the heterologous protein is a monoclonal antibody (mAb) or an equivalent thereof, including but not limited to: a mAb or an equivalent thereof recognizing and binding to VEGFR (such as Avastin™), or a mAb or an equivalent thereof recognizing and binding to HER2 (such as Herceptin™), or a mAb or an equivalent thereof recognizing and binding to EGFR (such as Erbitux™) or a mAb or an equivalent thereof that regulates immune checkpoints (also broadly known as "checkpoint antibody"), such as one recognizing and binding to CTLA4 [for example Yervoy™ (ipilimumab)], or one recognizing and binding to PD-1 [for example Keytruda™ (pembrolizumab) and Opdivo™ (nivolumab)], or one recognizing and binding to PD-L1 (for example, Tecentriq™ (atezolizumab)]. In another embodiment, the heterologous protein is selected from the group of Granulocyte-macrophage colony-stimulating factor (GM-CSF) or an equivalent thereof, an interleukin such as IL-2 or IL-15, or an interferon such IFNβ or IFNγ; or a natural bioactive peptide, such as thymosin A or adiponectin, or a synthetic peptide such as hexarelin. In one embodiment, the recombinant oncolytic HSV virus carries/comprises a polynucleotide encoding an albumin-PTEN fusion protein selected from the polynucleotides of SEQ ID NO:54-70, 74-77, 135-160 and a polynucleotide encoding a PTEN selected from the polynucleotides of SEQ ID NO:71-73, 171-172, 166-167, 198-200, 204-206. In a further embodiment, the recombinant oncolytic HSV virus carries/comprises a polynucleotide encoding an albumin-PTEN fusion protein selected from the polynucleotides of SEQ ID NO:54-70, 74-77, 135-160 and a polynucleotide encoding a PTEN selected from the polynucleotides of SEQ ID NO: 171-172, or 166-167. In yet a further embodiment, the oncolytic HSV vector further comprises a polynucleotide encoding a heterologous protein as described herein (a second transgene). In one embodiment, the oncolytic HSV vector further comprises an engineered polynucleotide sequence selected from SEQ ID NOs: 74 to 77 and 161, or a polynucleotide at least 90% identical to any one of SEQ ID NOs: 74 to 77 and 161 and encoding the same amino acid sequence as encoded by SEQ ID NOs: 74 to 77 and 161, respectively. In certain embodiments, the oncolytic HSV vector comprises, or alternatively consists essentially of, or yet further consists of one or more engineered polynucleotides selected from any polynucleotides as summarized in Table 1 and listed herein, or a polynucleotide sequence at least 90% identical thereto which encodes the same amino acid sequence.

In one embodiment, a recombinant Adenovirus vector (rAdV) is a non-replicating and non-disseminating AdV [(ΔE1A;ΔE1B;ΔE3)-AdV, wherein the E1A, E1B and E3 AdV proteins are all deleted, such that the viral vector can neither replicate in infected cells nor disseminate in other non-infected cells, thereby being efficacious and also very safe to apply in a subject]. In a further embodiment, the recombinant adenovirus vector comprises a polynucleotide of an albumin-PTEN fusion cDNA selected from the group of SEQ ID NO:58, 59, 68, 54-57, 60-67, 69-70, 74-77, 135-136, or 137-160. In a further embodiment, the recombinant adenovirus vector comprises two transgenes, as it is known in the art (Suzuki et al, 2015: PMID: 25588742), wherein one transgene comprises a polynucleotide of an albumin-PTEN fusion cDNA selected from the group of SEQ ID NO:58, 59, 68, 54-57, 60-67, 69-70, 74-77, 135-136, 137-160 and the second transgene comprises a polynucleotide of an albumin-p53 fusion cDNA selected from the group of SEQ ID NO:78 or 161. In certain embodiments, the rAdV vector is constructed by homologous recombination in bacteria using the AdEasy plasmid system, such as SEQ ID NO:210. In certain embodiments, a plasmid bearing the albumin-PTEN fusion cDNA is digested with PacI and transformed into HEK293 cells. In certain embodiments, the rAdV is plaque-purified in BMAd-E1, an A549 cell expressing the adenovirus E1 gene (described in Gilbert et al, 2014; PMID: 25159033). In certain embodiments, the rAdV is amplified using SF-BMAd-R cells (Gilbert et al, 2014; PMID: 25159033) and purified over cesium chloride gradients. In one embodiment, the titer of infectious particles is measured using tissue culture infectious dose 50% (TCID50%) assay. Additionally or alternatively, the ability of the cDNA selected from the group of SEQ ID NO:58, 59, 68, 54-57, 60-67, 69-70, 74-77, 135-136, 137-160 to drive expression of the corresponding PTEN-albumin fusion (SEQ ID NO: 18, 19, 28, 14-17, 20-27, 29-30, 34-37, 49-50 and 109-132, respectively) is investigated in the cell lysate and in the cell culture medium by western blots using anti-PTEN or anti-albumin antibodies (see, for example, FIG. 6B). In certain embodiments, the efficacy of the rAdV is assayed on cultured cancer cells or on a subject in need thereof, such as xenografted mice or human cancer patients. In one embodiment, a recombinant Adenovirus vector (rAdV) is a replicating (oncolytic) but non-disseminating rAdV [for example, (ΔE1A;ΔPS)-AdV, wherein the E1A protein and the AdV protease PS facilitating virus dissemination are deleted, such that the viral vector can replicate in infected cells but not disseminate in other non-infected cells, thereby being both very efficacious and very safe to apply in a subject]. In a further embodiment, the rAdV comprises an albumin-PTEN fusion cDNA selected from the group of SEQ ID NO:58, 59, 68, 54-57, 60-67, 69-70, 74-77, 135-136, 137-160. In yet a further embodiment, the rAdV vector is constructed by homologous recombination in bacteria using pAd(dps)ΔCU-IRES-E1A (Bourbeau et al, 2007; PMID: 17409449) (see, for example, SEQ ID NO:211). In one embodiment, a plasmid bearing the albumin-PTEN fusion cDNA is digested with PacI and transformed into HEK293A-CymR-PS cells [a HEK293A cell line that stably expresses the adenoviral protease under the control of the cumate repressor (Haq et al, 2019; PMID: 31506193 and references therein); it is noted cumR prevents synthesis of the foreign genes inserted in the AV vector, thereby reducing damage to the cells during production to enable higher rAdV yields; cumR can be derepressed upon addition of coumermycin in the cell medium]. In a further embodiment, the rAdV is then plaque-purified in BMAd-E, an A549 cell expressing the adenovirus E1 gene (described in Gilbert et al, 2014; PMID: 25159033). In yet a further embodiment, the rAdV is amplified using SF-BMAd-PS cells [an A549 cell line expressing the adenovirus E1 gene; Gilbert et al, 2013; abstract #135; DOI: 10.1016/S1525-0016(16)34470-7] and purified over cesium chloride gradients. Additionally or alternatively, the titer of infectious particles is measured using tissue culture infectious dose 50% (TCID50%) assay. In a further embodiment, the ability of the transgene cDNA selected from the group of SEQ ID NO:58, 59, 68, 54-57, 60-67, 69-70, 74-77, 135-136, 137-160 to drive expression of the corresponding PTEN-albumin fusion (SEQ ID NO: 18, 19, 28, 14-17, 20-27, 29-30, 34-37, 49-50 and 109-132, respectively) is investigated in the cell lysate and in the cell culture medium by western blots using anti-PTEN or anti-albumin antibodies (see, for example, FIG. 6B). In yet a further embodiment, the efficacy of the rAdV is assayed on cultured cancer cells or on a subject in need thereof, such as xenografted mice or human cancer patients. In one embodiment, the rAdV is AdV5 (serotype 5). In another embodiment the rAdV is AdV3. In other embodiments, the rAdV is of mixed serotype such as AdV5/3, wherein each serotype is selected from the 50 serotypes of AdV, and in accordance with species infectivity in a subject. In yet a further embodiment, the AdV vector further comprises a polynucleotide encoding a heterologous protein as described herein (a second transgene). In one embodiment, the AdV vector further comprises an engineered polynucleotide sequence selected from SEQ ID NOs: 74 to 77 and 161, or a polynucleotide at least 90% identical to any one of SEQ ID NOs: 74 to 77 and 161 and encoding the same amino acid sequence as encoded by SEQ ID NOs: 74 to 77 and 161, respectively. In certain embodiments, the AdV vector comprises, or alternatively consists essentially of, or yet further consists of one or more engineered polynucleotides selected from any polynucleotides as summarized in Table 1 and listed herein, or a polynucleotide sequence at least 90% identical thereto which encodes the same amino acid sequence.

Other aspects of this disclosure relate to isolated cell comprising the polynucleotide and/or vectors as disclosed herein. Non-limiting examples of an isolated cell is a prokaryotic cell such as a bacteria cell, e.g., an *E coli*, or a eukaryotic cell. In another aspect, the isolated cell is a eukaryotic cell. In some embodiments the isolated eukaryotic cell is selected from an animal cell, a mammalian cell, a bovine cell, a feline cell, a simian, a canine cell, a murine cell, an equine cell or a human cell. In one aspect, the host cell is a Chinese Hamster Ovary (CHO) cell.

The polynucleotides, vectors and host cells are useful for the recombinant production of the fusion proteins. Further provided are the recombinant polypeptides produced by expressing the polynucleotide in host cell and growing the cell under conditions that favor the expression of the polynucleotide. In a further aspect, the recombinant fusion protein is isolated from the cell or culture media.

In a further aspect, the polypeptides, proteins, analogues, variants, fragments, vectors or host cells are detectably labeled or labeled with a purification marker.

In one aspect, the albumin-PTEN fusion protein is produced by a process comprising the step of culturing a host cell capable of expressing a polynucleotide encoding the albumin-PTEN fusion protein under conditions suitable for expression of the albumin-PTEN polynucleotide and optionally further comprising isolating the fusion protein produced by the cell from the cell culture or culture medium. The cell can be prokaryotic or a eukaryotic, such as a Chinese hamster ovary (CHO) cell.

In a further preferred embodiment, a fusion protein of the invention is processed by a host cell and secreted into the surrounding culture medium. Processing of the nascent fusion protein that occurs in the secretory pathways of the host used for expression may include, but is not limited to signal peptide cleavage; formation of disulfide bonds; proper folding; addition and processing of carbohydrates (such as for example, N- and O-linked glycosylation); specific proteolytic cleavages; and assembly into multimeric proteins. A fusion protein of the invention is preferably in the processed form. In a most preferred embodiment, the "processed form of a fusion protein" or "processed form of a pre-protein" or "mature protein" refers to a fusion protein product which has undergone N-terminal signal peptide cleavage, herein also referred to as a "mature fusion protein". Examples of signal peptides are disclosed as SEQ ID NO:93-105.

Compositions

Also provided are compositions comprising one or more of the fusion protein, polynucleotide, vector, host cell and a carrier, e.g., a pharmaceutically acceptable carrier. In one aspect, provided herein are pharmaceutical compositions comprising, or consisting essentially of, or yet further consisting of, the fusion protein (for example, the albumin-PTEN fusion protein) as disclosed herein, and at least one pharmaceutically acceptable carrier. The compositions optionally comprise an additional therapeutic agent, e.g., a chemotherapeutic agent. Thus, further provided are methods for inhibiting the growth of a cancer cell by contacting the cell with an effective amount of a fusion protein as disclosed herein. The contacting can be in vitro or in vivo. When practiced in vitro, the methods are useful to test for the effectiveness of the fusion polypeptide against a cancer, alone or in combination with other therapies. When practiced in vitro in an animal, the method provides a convenient animal model to test for effectiveness.

In certain embodiments, the composition further comprising a combined therapy. In one embodiment, the combined therapy is selected from the group of 1) natural bioactive peptides (thymosin A; adiponectin); 2) FDA and/or EMA-approved anti-cancer drugs that either are potentiated by PTEN or function via intact PTEN or for which loss of response (resistance) is correlated/driven by loss of PTEN, such as (a) Cytotoxics: cisplatin, doxorubicin, vinorelbin, melphalan; taxol; bromocriptine/artenusate, camptothecin; (b) Immunomodulatory: thalidomide; rapamycin, fingolimod/FTY20; (c) VEGF inhibitors: Sutent™, Avastin™; (d) Tyrosine Kinase Inhibitors: Tarceva™; Icotinib, imatinib, dasatinib; (e) HER2 mAbs: Herceptin™, (f) anti-EGFR mAbs, e.g. Erbitux™, (g) PD1/PD-L1 ("checkpoint") mAbs:e.g. Yervoy™, Opdivo™ etc.; (f) PARP inhibitors: Glynparza™; (h) Emerging anti-cancer drug classes: BET inhibitors; (i) Anti-malarials: artesunate; (j) Anti-pain drugs: tramadol, lidocaine; (k) Anti-psychotic drugs: valproic acid; (1) Anti-metabolic syndrome drugs (now emerging as anti-cancerones as well): simvastatin, atorvastatin, metformin, resveratrol, catoptril, losartan, pioglitazone (m) Anti-inflammatory: celecoxib, aspirin, nimesulide, montelukast, diclofenac; (n) Anti-tape worm infections (niclosamide); (o) Antibiotics: docycyclin, alborixin; (p) Growth Hormone releasers: hexarelin; and (q) Botulimum toxin type A.

In one embodiment, the combined therapy is a purified protein drug. Non-limiting examples include a therapeutic mAb, a therapeutic protein [such as granulocyte-macrophage colony-stimulating factor (GM-CSF) or an equivalent thereof, an interleukin (such as IL-2 or IL-15), an interferon such as (IFNβ or IFNγ)], a natural bioactive peptide (such as thymosin A or adiponectin), or a synthetic peptide such as hexarelin or adiponectin. In a further embodiment, the therapeutic mAb is selected from the group of: a mAb or an equivalent thereof recognizing and binding to VEGFR (such as Avastin™), a mAb or an equivalent thereof recognizing and binding to HER2 (such as Herceptin™), a mAb or an equivalent thereof recognizing and binding to EGFR (such as Erbitux™), a mAb or an equivalent thereof that regulates immune checkpoints {such as one recognizing and binding to CTLA4 [for example Yervoy™ (ipilimumab)], or one recognizing and binding to PD-1 [for example Keytruda™ (pembrolizumab) and Opdivo™ (nivolumab)], or one recognizing and binding to PD-L1 (for example, Tecentriq™ (atezolizumab)]}.

In certain embodiments, the combined therapy is a small molecule drug, for example, a PARP inhibitor; a BET inhibitor, a chemotherapeutic drug, an anti-malarial, an anti-pain drug; an anti-psychotic drug, an anti-metabolic syndrome drugs (for example metformin); an anti-inflammatory drug, an anti-tape worm infection drug, an antibiotic, such as an antimicrobial; or botulinum toxin type A.

Briefly, pharmaceutical compositions of the present invention including but not limited to any one of the claimed compositions may comprise the fusion protein, or polynucleotide (for example, the optimized polynucleotide sequence encoding the fusion protein), vector, host cell and a carrier as described herein, in combination with one or more pharmaceutically or physiologically acceptable carriers, diluents or excipients. Such compositions may comprise buffers such as neutral buffered saline, phosphate buffered saline and the like; carbohydrates such as glucose, mannose, sucrose or dextrans, mannitol; proteins; polypeptides or amino acids such as glycine; antioxidants; chelating agents such as EDTA or glutathione; adjuvants (e.g., aluminum hydroxide); stabilizers, and preservatives. Compositions of the present disclosure may be formulated for oral, intravenous, topical, enteral, intra-tumoral and/or parenteral administration. In certain embodiments, the compositions of the present disclosure are formulated for intravenous administration.

METHODS OF USE

Aspects of the disclosure relate to a method of inhibiting the growth of a cancer cell (or a tumor expressing a cancer or tumor antigen), by contacting the tumor with an effective amount of the fusion protein, polynucleotide (for example, those encoding a fusion protein and/or a transgene), vector, or compositions disclosed above. The contacting can be in vitro, ex vivo or in vivo. When the contacting is in vitro or ex vivo, the method can be used to test personalized therapy against a patient's tumor or cancer or to assay for combination therapies. When the contacting is in vivo, the method is useful to inhibit the growth of the tumor or cancer cell in a subject in need thereof, such as a human patient suffering from cancer and the patient receives an effective amount of the fusion protein, polynucleotide (for example, those encoding for the fusion protein), or vector. In certain embodiments, the tumor is a solid tumor. An effective amount is administered alone or in combination with other therapies as described herein. In certain embodiments, the cancer/tumor targeted is a solid tumor or a cancer affecting the blood and/or bone marrow, e.g., multiple myeloma (MM). In another aspect, the method further comprises, or consists essentially of, or yet further consists of, administering to the subject an effective amount of a cytoreductive therapy. The therapy can be a first line, second line, third line etc. and will be administered by a method to deliver an effective amount of the fusion protein, polynucleotide, or vector to the cell or tumor.

Administration of one or more of the proteins, polynucleotides, vectors or compositions can be effected in one dose, continuously or intermittently throughout the course of treatment. Methods of determining the most effective means and dosage of administration are known to those of skill in the art and will vary with the composition used for therapy, the purpose of the therapy and the subject being treated. Single or multiple administrations can be carried out with the dose level and pattern being selected by the treating physician. Suitable dosage formulations and methods of administering the agents are known in the art. In a further aspect, the fusion protein and composition of the invention can be administered in combination with one or more of other treatments, including but not limited to: 1) natural bioactive peptides (thymosin A; adiponectin); 2) FDA and/or EMA-approved anti-cancer drugs that either are potentiated by PTEN or function via intact PTEN or for which loss of response (resistance) is correlated/driven by loss of PTEN, such as (a) Cytotoxics: cisplatin, doxorubicin, vinorelbin, melphalan; taxol; bromocriptine/artenusate, camptothecin; (b) Immunomodulatory: thalidomide; rapamycin, fingolimod/FTY20; (c) VEGF inhibitors: Sutent™, Avastin™; (d) Tyrosine Kinase Inhibitors: Tarceva™; Icotinib, imatinib, dasatinib; (e) HER2 mAbs: Herceptin™, (f) anti-EGFR mAbs, e.g. Erbitux™, (g) PD1/PD-L1 ("checkpoint") mAbs:e.g. Yervoy™, Opdivo™ etc.; (f) PARP inhibitors: Glynparza™; (h) Emerging anti-cancer drug classes: BET inhibitors; (i) Anti-malarials: artesunate; (j) Anti-pain drugs: tramadol, lidocaine; (k) Anti-psychotic drugs: valproic acid; (1) Anti-metabolic syndrome drugs (now emerging as anti-cancerones as well): simvastatin, atorvastatin, metformin, resveratrol, catoptril, losartan, pioglitazone (m) Anti-inflammatory: celecoxib, aspirin, nimesulide, montelukast, diclofenac; (n) Anti-tape worm infections (niclosamide); (o) Antibiotics: docycyclin, alborixin; (p) Growth Hormone releasers: hexarelin; and (q) Botulimum toxin type A. A string of studies have shown that both animal models and human patients treated with checkpoint mAbs develop resistance to these agents when the PTEN tumor suppressor is functionally inactivated in tumor cells. It is widely accepted that functional PTEN tumor suppressor maintains tumors in a relatively "hot" configuration (i.e., tumors are visible to the immune system and are attacked by it), whereas loss of PTEN renders tumors "cold", wherein the immune system is inactivated or anergic (reviewed in Chen & Eng, 2019; PMID: 30928438). In fact, Chen & Eng, 2019; PMID: 30928438 state that PTEN is anticipated to synergize with checkpoint mAbs. Consistently, when PTEN-L is delivered via an HSV1 viral vector into mice with glioblastoma (GBM) (a cold brain tumor), the levels of PD-L1 are significantly reduced and the mice survive for ultra-long periods of time, (Russell et al, 2018; PMID: 30479334). Because the PTEN-albumin fusions disclosed herein are equivalent to PTEN-L with respect to tumor suppressor function, in view of Russell et al, 2018; PMID: 30479334 and Chen & Eng, 2019; PMID: 30928438, it is anticipated that PTEN-albumin fusions synergize with checkpoint antibodies to treat tumors or cancer in a subject, wherein the said fusions reduce the levels of PD-L1 in the tumor/cancer and/or reduce the levels of checkpoint mAb normally required to treat the tumor/cancer in the subject.

In certain embodiments, the recombinant viral vector or any other vector as described herein is further combined with another therapy, such as a purified protein drug. Non-limiting examples include a therapeutic mAb (for example Avastin™, Herceptin™, Yervoy™ Keytruda™, Opdivo™, Tecentriq™ etc.), or a therapeutic protein, such as GM-CSF, an interleukin, an interferon, thymosin A, hexarelin or adiponectin. In certain embodiments, the combined therapy is a small molecule drug, for example, a PARP inhibitor; a BET inhibitor, a chemotherapeutic drug, an anti-malarial, an anti-pain drug; an anti-psychotic drug, an anti-metabolic syndrome drugs (for example metformin); an anti-inflammatory drug, an anti-tape worm infection drug, an antibiotic, such as an antimicrobial; or botulinum toxin type A. In one embodiment, the combined treatment comprises administrating a fusion protein and/or a vector as disclosed herein and a combined therapy concurrently, sequentially and/or separately to a subject in need thereof. In one embodiment the fusion protein, vector and combined therapy are administrated to the subject via the same administration route. In another embodiment, different administration route is used. In certain embodiments, there is an about 0.5 hour, about 1 hour, about 2 hours, about 3 hours, about 4 hours, about 5 hours, about 6 hours, about 7 hours, about 8 hours, about 12 hours, about 1 day, about 2 days, about 3 days, about 4 days, about 5 days, about 6 days, about 1 week, about 2 weeks or about 1 months gap in any of the two administrations.

In certain embodiments, any combination therapy as described herein achieves a synergistic effects in treating a disease, such as a cancer.

Also provided is a method of treating a cancer, comprising administering an effective amount of one or more of a fusion protein, a polynucleotide, a vector, or a pharmaceutical composition as described herein to a subject in need thereof. In one embodiment, the method comprise administering an effective amount of a fusion protein and a polynucleotide or a vector as described herein. In a further embodiment, the method further comprises administering an effective amount of a combined treatment, whereby a synergistic effect is achieved in treating cancer.

Additionally provided is a method for delivering a fusion protein, a polynucleotide (for example, those encoding a fusion protein), a vector, or a pharmaceutical composition as described herein to a subject in need thereof. In certain embodiments, the fusion protein, polynucleotide or vector is delivered to the extracellular matrix (ECM) of a cancer of the subject.

In one embodiment, the subject is suspected of having and/or is diagnosed with a cancer or a disease associated with low expression or lacking expression of a PTEN.

Additionally or alternatively, the subject has a high expression level of a miRNA targeting the 3' of the PTEN tumor suppressor mRNA compared to a control. In one embodiment, the control is a biological sample from a subject who is free of any cancer or tumor. In another embodiment, the control is a biological sample from a healthy subject. In yet another embodiment, the control is any other cancer or tumor. A non-limiting example of the miRNA is miR-21, any other onco-miR(s) or any combination thereof. In one embodiment, the expression level of the miRNA is detected in a liquid biological sample (such as a liquid biopsy) of the subject. Such a sample includes, but is not limited to, blood, serum or plasma. In a further embodiment, efficacy of a fusion protein, polynucleotide, vector, composition, and/or method as disclosed herein is monitored and/or accessed via detecting the expression of a miRNA. Non-limiting examples of a desired efficacy include a successful treatment of a cancer in a subject, inhibition of a cancer cell growth or metastasis in vivo, ex vivo or in vitro, PTEN increase in a cancer at the mRNA and/or protein level, and/or increase of a PTEN protein or a PTEN polypeptide fragment in a peri-cancerous area. In one embodiment, a decreased expression of miR-21, any other onco-miR(s) or any combination thereof indicates a desired efficacy, optionally using one or more of the primers having a nucleotide sequences of SEQ ID NO:206-208.

In one embodiment, the cancer is a solid tumor (e.g., carcinoma or sarcoma) or a non-solid cancer (for example, a blood cancer). Additionally or alternatively, the cancer or tumor is a primary or metastatic cancer or tumor. In a further embodiment, the cancer is selected from a gastric cancer, a colorectal cancer, a prostate cancer, a breast cancer, a triple negative breast cancer, an ovarian carcinoma, a renal cell carcinoma, an Ewing sarcoma, a melanoma, a mesothelioma, a lung cancer, a non-small cell lung cancer, a stage IV lung cancer, a brain cancer, a glioblastoma, a lymphoma, a leukemia, or a multiple myeloma (MM). In another embodiment, the cancer affects the blood and/or bone marrow.

In one embodiment, the cancer lacks expression (or has a low expression level) of a PTEN protein. In a further embodiment, the cancer has a modified Histopathology score (H score) for PTEN of about 20 or lower. An H score has been used by one of skill in the art in quantifying expression of a certain protein in immunohistochemistry and related fields. In one embodiment, the H score of PTEN expression is calculated as the product of the percentage of cells staining at an established intensity (0=no staining, 1+=intermediate/decreased, 2+=full) relative to the internal positive control giving a product ranging from 0 to 200 as an H score, wherein the staining intensity of the IHC sample is evaluated blindly by at least two independent pathologists (Sangale et al, 2011; PMID: 20930614). In a further embodiment, the internal positive control is an endothelium or tumor stroma, set at 2+. In another embodiment, the PTEN IHC uses the SP218 or the 138G6 mAbs (see FIG. 6B). In another embodiment, the PTEN IHC method is validated by an independent party, including a contract research organization which is preferably certified by a notified body, or has Clinical Laboratory Improvement Amendments (CLIA) or College of American Pathologists (CAP) certification. In another embodiment, PTEN IHC staining intensity is computer assisted (Rulle et al, 2018; PMID: 30240851). In another aspect, PTEN IHC is combined with flow cytometry ("histo-cytometry") so as to facilitate multiplex quantitative tissue imaging analysis & biomarker-related phenotyping of the immune cells ("immunophenotyping") within the patient tumor tissue IHC, in line with the pivotal role played by PTEN proteins, including PTEN-L, in the regulation of the immune system (Russell et al, PMID: 30479334). In yet a further embodiment, the cancer or tumor comprises a dysfunctional/inactive PTEN, the function of which can be measured in an in vitro or ex vivo assay such as the Malachite Green phosphatase assay, or an in vivo assay such as an assay measuring cell penetration in a mammalian cell or another cell-based assay measuring tumor suppressor function, including the activation of cell death, as is known in the art or described herein.

In one embodiment, the cancer or tumor comprises an increased pi3K pathway pharmacodynamics biomarkers compared to a control. In a further embodiment, the control is a biological sample from a subject who is free of any cancer or tumor. Or, the control is a biological sample from another cancer or tumor. The biomarker(s) is selected from the group of: AKT Serine/Threonine Kinase (AKT), phosphorylated proline-rich Akt substrate of 40 kDa (pPRAS40), pGSK3 (glycogen synthase kinase 3), pFOXO (Forkhead family of transcription factors)or phosphorylated Ribosomal Protein S6 Kinase B1 (pS6K).

Any of the methods as disclosed herein further comprise monitoring efficacy prior to, concurrently with, and/or after performing the method or any step(s) recited in the method. In one embodiment, the efficacy is evaluated and/or quantified as a treatment of a disease (for instance a cancer) in a subject, an inhibition of a cancer cell growth, and/or a biomarker change.

The biomarker change as used herein may refer to an expression change of a cancer cell marker (such as an onco-miR, and/or a pi3K pathway pharmacodynamics biomarker), and/or an expression change of a molecule (for example a polynucleotide or a polypeptide) lack in a cancer cell or expressed at a low level in a cancer cell compared to a control (such as a PTEN). In one embodiment, a desired efficacy is observed after performing a method as disclosed herein.

In another embodiment, both efficacy outcomes and PD biomarker can be simultaneously determined in the cancer or tumor in a subject. In a non-limiting example, a rodent bearing a human tumor xenograft is used. Human tumor cells, preferably engineered to express a bioluminescent gene, such as Luciferase, are transplanted into a rodent (such as a mice or a rat), allowing visualization by injection of an activatable fluorescence optical imaging agent in the rodent. A suitable tumor cell includes but is not limited to 4T1-Luc mouse breast cancer cell line while the agent may be selected from: MMPSense 645 FAST (catalog #NEV11112), Cat B680 FAST (catalog #NEV 10126) and similar agents (FAST platform, PerkinElmer, Waltham, Mass.). In one embodiment, the optical imaging agent is sensitive to and activatable by proteases such as MMP2/9, Cathepsin B and other cancer-associated proteases, which are in much higher concentrations in the peri-cancerous areas as opposed to normal tissues, thereby allowing for quantitative & multichannel measurement of protease action in the subject at the desired wavelength (e.g. 645 nm, 680 nm, 750 nm), and for correlation of the quantified fluorescence to cancer progression and pathologic response, wherein the latter is independently quantified by Luciferase activity in the same tumor nodule of the subject and at the same time.

In another embodiment, a subject with cancer and under treatment with an anti-cancer drug can be further treated with a properly labeled version of the same anti-cancer agent, including a near-infrared fluorescent agent-mediated labeling and/or a cancer protease-activatable probe, and then live-imaged with non-invasive optical imaging at two or more wavelengths, thereby simultaneously visualizing & quantifying distribution of the drug in the tumor and other parts of the subject and protease action as a function of time. In certain embodiments, the subject can be an animal, such as a rodent, or preferably a rat, or even more preferably a mouse. In certain embodiments, the subject may or may not have cancer. In certain embodiments, the subject may be a rat or a mouse bearing a tumor allograft, wherein the grafted tumor is from the same species (syngeneic tumor) or other species, such as human (allogeneic tumor). In certain embodiments, the tumor may be from an established cell line (CDX grafts) or from a freshly-derived patient biopsy tissue (PDX graft). In certain embodiments, the tumor maybe excised from the subject following imaging and processed for IHC, flow cytometry, immunophenotyping and other techniques, thereby correlating drug biodistribution/imaging in the subject with (pre)clinical response to therapy and morphological, anatomical, subcellular and molecular attributes such as pharmacodynamic or imaging biomarkers.

In some embodiments, a biomarker is prognostic of disease outcome, i.e. inform on the general course and outcome of the disease regardless of subject treatment. Such prognostic biomarkers are typically selected from IHC antigen cohorts and can be cytokeratins, vimentin, cell-adhesion molecules, oncogenes, tumor suppressors, and many others, as is known in the art or described herein. In other embodiments, these biomarkers are predictive of disease outcome in response to a specific drug, such as the albumin-PTEN fusions claimed herein. As a non-limiting example, and without being bound by theory, because PTEN protein levels correlate with tumor outcome, whereas an onco-miR (such as miR-21) also inversely correlate with both PTEN levels and subject overall survival, an onco-miR predicts treatment outcome (predictive biomarker) in a subject dosed with an albumin-PTEN composition selected of: a purified albumin-PTEN protein preparation for subject use, a gene therapy preparation comprising a polynucleotide encoding for an albumin-PTEN protein, mRNA therapy comprising a polynucleotide encoding for an albumin-PTEN protein, combinations thereof and/or combinations of each thereof, or combinations of each thereof with other treatments, as is known in the art of described herein. In one embodiment, measurement of the onco-miR predictive biomarker is performed in subject blood (liquid biopsy). In another embodiment, the onco-miR predictive biomarker is determined in a tissue extract, preferably a cancer tissue extract. In another embodiment, the onco-miR predictive biomarker has an accuracy of 70% or 75% or 80% or even higher. In another embodiment, the onco-miR levels are measured by RT-PCR using total RNA extracted from the serum portion of venous blood of cancer patients and non-cancer volunteers, using the RT primer of SEQ ID NO:207 and PCR primers with SEQ ID NO:208-209.

Methods of Production and Compositions thereof

Also provided is a method of producing a fusion protein/polypeptide as described herein. The method comprises culturing a host cell capable of expressing the fusion protein under conditions suitable for expression of the fusion protein.

In one embodiment, the host cell is a prokaryotic cell or a eukaryotic cell. In a further embodiment, the host cell is a mammalian cell. Additionally or alternatively, the host cell is a cell line. In yet a further embodiment, the host cell is selected from the group of a Chinese hamster ovary (CHO) cell, or a HEK293 cell. In one embodiment, the CHO cell is a CHO-3E7 cell having an ExPASy accession number of CVCL_JY74. In another embodiment, the HEK293 cell is aHEK293-EBNA1-6E having an ExPASy accession number of CVCL_HF20. Suitable conditions for culturing the host cell and/or expression of the fusion protein can be found, for example, at www.atcc.org/en/Guides.aspx. In one embodiment, the host cell is a natural furin knock-out (KO) cell or cell line. In a further embodiment, the host cell is a colorectal cancer cell. In yet a further embodiment, the host cell is a LoVo cell. See, for example, Susan-Resiga et al. 2011, PMID: 21550985.

In certain embodiments, the host cell lacks (or has a low level of) expression of a protease which is able to cleave the fusion protein. In one embodiment, the protease is an intracellular protease or a protease present in a peri-cancerous cell or tissue. In a further embodiment, the protease is selected from the group of furin, MMP2/9 or Cathepsin B.

In one embodiment, the protease is selected from the group of ADAM8, ADAM9, ADAM10, ADAM12, ADAM15, ADAM17/TACE, ADAMDEC1, ADAMTS1, ADAMTS4, ADAMTS5, Aspartate proteases, e.g., BACE, Renin, Aspartic cathepsins, e.g., Cathepsin D, Cathepsin E, Caspases, e.g., Caspase 1, Caspase 2, Caspase 3, Caspase 4, Caspase 5, Caspase 6, Caspase 7, Caspase 8, Caspase 9, Caspase 10, Caspase 14, Cysteine cathepsins, e.g., Cathepsin B, Cathepsin C, Cathepsin K, Cathepsin L, Cathepsin S, Cathepsin V/L2, Cathepsin X/Z/P, Cysteine proteinases, e.g., Cruzipain, Legumain, Otubain-2, KLKs, e.g., KLK4, KLK5, KLK6, KLK7, KLK8, KLK10, KLK11, KLK13, KLK14, Metallo proteinases, e.g., Meprin, Neprilysin, PSMA, BMP-1, MMPs, e.g., MMP1, MMP3, MMP7, MMP8, MMP10, MMP11, MMP12, MMP13, MMP14, MMP15, MMP16, MMP17, MMP19, MMP20, MMP23, MMP24, MMP26, MMP27, Serine proteases, e.g., activated protein C, Cathepsin A, Cathepsin G, Chymase, coagulation factor proteases, (e.g., FVIIa, FIXa, FXa, FXa, FXIIa), Elastase, Granzyme B, Guanidinobenzoatase, HtrAl, Human Neutrophil Elastase, Lactoferrin, Marapsin, NS3/4A, PACE4, Plasmin, PSA, tPA, Thrombin, Tryptase, uPA, Type II Transmembrane, Serine Proteases (TTSPs), e.g., DESC1, DPP-4, FAP, Hepsin, Matriptase-2, MT-SP1/Matriptase, TMPRSS2, TMPRSS3 or TMPRSS4.

Additionally, the method further comprises purifying or isolating the fusion protein optionally from the cell or cell culture medium. In one embodiment, the purification and/or isolation step comprises lysing host cells to release the fusion protein expressed. In another embodiment, the purification and/or isolation step does not involve lysing host cells, instead, the fusion protein is secreted outside of the host cells. In one embodiment, after or during the culture, supernatant of host cells and/or the cell culture medium comprises about 1 µg/ml, about 2 µg/ml, about 3 µg/ml, about 4 µg/ml, about 5 µg/ml, about 10 µg/ml, about 15 µg/ml, about 20 µg/ml, about 25 µg/ml, about 30 µg/ml, about 40 µg/ml, about 50 µg/ml, about 100 µg/ml, more than about 1 µg/ml, more than about 2 µg/ml, more than about 3 µg/ml, more than about 4 µg/ml, more than about 5 µg/ml, more than about 10 µg/ml, more than about 15 µg/ml, more than about 20 µg/ml, more than about 25 µg/ml, more than about 30 µg/ml, more than about 40 µg/ml, more than about 50 µg/ml, more than about 100 µg/ml, about 1 µg/ml to about 100 µg/ml, about 1 µg/ml to about 50 µg/ml, about 1 µg/ml to about 25 µg/ml, about 1 µg/ml to about 20 µg/ml, about 1 µg/ml to about 15 µg/ml, about 1 to about 10 µg/ml, about 1 to about 5 µg/ml, about 5 µg/ml to about 100 µg/ml, about 5 µg/ml to about 50 µg/ml, about 5 µg/ml to about 25 µg/ml, about 5 µg/ml to about 20 µg/ml, about 5 µg/ml to about 15 µg/ml, about 5 µg/ml to about 10 µg/ml, about 10 µg/ml to about 100 µg/ml, about 10 µg/ml to about 50 µg/ml, about 10 µg/ml to about 25 µg/ml, about 10 µg/ml to about 20 µg/ml, about 10 µg/ml to about 15 µg/ml, about 15 µg/ml to about 100 µg/ml, about 15 µg/ml to about 50 µg/ml, about 15 µg/ml to about 25 µg/ml, about 15 to about 20 µg/ml, about 20 µg/ml to about 100 µg/ml, about 20 µg/ml to about 50 µg/ml, about 20 µg/ml to about 25 µg/ml, about 25 µg/ml to about 100 µg/ml, about 25 µg/ml to about 50 µg/ml, or about 50 µg/ml to about 100 µg/ml of secreted fusion protein. Detection and quantification of the fusion protein can be performed using an antibody which specifically recognizes and binds to the fusion protein, see the examples. It can also be detected via measuring a function of PTEN and/or the fusion protein in an in vitro assay such as the Malachite Green phosphatase assay, or an in vivo assay such as an assay measuring cell penetration in a mammalian cell or another cell-based assay measuring tumor suppressor function, including the activation of cell death, as is known in the art or described herein. Also, various technologies may be used in this purification/isolation step, for example, albumin affinity chromatography and/or a heparin affinity chromatography.

The fusion protein as disclosed herein comprises a naturally long half-life protein or protein domain (such as serum albumin). Such fusion protein may be further modified to have a high stability and/or a low aggregation compared wild type protein, for example, via polysialylation to a negatively charged amino acid. Additionally, polynucleotide(s) and vector(s) encoding a fusion protein were optimized for better expression in the host cells. Without wishing to be bound by the theory, those properties allow a productive and efficient method of producing the fusion protein with a high yield.

Also provided is a host cell comprising one or more of the polynucleotides and/or one or more of the vectors as disclosed. In one embodiment, the host cell is a prokaryotic cell or a eukaryotic cell. In a further embodiment, the host cell is a mammalian cell. Additionally or alternatively, the host cell is a cell line. In yet a further embodiment, the host cell is selected from the group of a Chinese hamster ovary (CHO) cell, or a HEK293 cell. In one embodiment, the CHO cell is a CHO-3E7 cell having an ExPASy accession number of CVCL_JY74. In another embodiment, the HEK293 cell is a HEK293-EBNA1-6E having an ExPASy accession number of CVCL_HF20. In certain embodiment, the host cell lacks expression of a protease which is able to cleave the fusion protein. In one embodiment, the protease is an intracellular protease or a protease present in a peri-cancerous cell or tissue. In a further embodiment, the protease is selected from the group of furin, MMP2/9 or Cathepsin B. In one embodiment, the host cell is a natural furin knock-out (KO) cell or cell line. In a further embodiment, the host cell is a colorectal cancer cell. In yet a further embodiment, the host cell is a LoVo cell. See, for example, Susan-Resiga et al. 2011, PMID: 21550985.

In one embodiment, a furin protein (for example, PR33 and PR34) is produced/manufactured using wild-type CHO cells. In another embodiment, a furin protein (for example, PR402, PR61, PR6, PR405, PR407 PR33, and/or PR34) is produced/manufactured using furin KO host cells, such as LoVo.

Methods of Manufacture

Also provided is a method of manufacture of a fusion protein with a high yield, a low aggregation and/or a high stability. In one embodiment, such method allows for one or more of the following: a large-scale protein production (for example, medium used in culturing host cells secreting the fusion protein containing at least about 5 µg/ml of the fusion protein), a high yield (for example, compared to the currently available production method for a wild type PTEN), a continuous processing (for example, collecting culture medium of the host cells containing secreted fusion protein, optionally via a filter, without interrupting the growth of the host cells and/or without collecting and lysing the host cells to release the expressed fusion protein), or a produced fusion protein with low aggregation and/or high stability (for example, compared to a wild type PTEN).

Multiple methods or kits may be used to evaluate the yield, aggregating property or stability of the produced protein, such as those revealed in the examples as well as BCA Protein Assay Kit for quantifying the yield; ultracentrifugation, size-exclusion chromatography, gel electrophoresis, dynamic light scattering, or turbidity measurements for evaluating the protein aggregates; and Differential Scanning Calorimetry (DSC), Pulse-Chase Method, Bleach-chase method, Cycloheximide-chase method, Circular Dichroism (CD) Spectroscopy, or Fluorescence-based Activity Assays for accessing the stability. See, e.g., www.abcam.com/bca-protein-assay-kit-ab102536.html, www.enzolifesciences.com/science-center/technotes/2017/september/what-are-the-different-methods-of-determining-protein-aggregation?/, den Engelsman J et al (2010), PMID: 20972611, info.gbiosciences.com/blog/methods-of-determining-protein-stability, and www.news-medical.net/white-paper/20161027/A-Comprehensive-Guide-to-Protein-Stability-Assay-Platforms.aspx.

The method comprises culturing a host cell capable of expressing the fusion protein under conditions suitable for expression of the fusion protein. The host cell may be any host cell as described herein.

Additionally, the method further comprises purifying or isolating the fusion protein optionally from the cell or cell culture medium. In one embodiment, the purification and/or isolation step comprises lysing host cells to release the fusion protein expressed. In another embodiment, the purification and/or isolation step does not involve lysing host cells, instead, the fusion protein is secreted outside of the host cells. In one embodiment, after or during the culture, supernatant of host cells and/or the cell culture medium comprises about 1 µg/ml, about 2 µg/ml, about 3 µg/ml, about 4 µg/ml, about 5 µg/ml, about 10 µg/ml, about 15 µg/ml, about 20 µg/ml, about 25 µg/ml, about 30 µg/ml, about 40 µg/ml, about 50 µg/ml, about 100 µg/ml, more than about 1 µg/ml, more than about 2 µg/ml, more than about 3 µg/ml, more than about 4 µg/ml, more than about 5 µg/ml, more than about 10 µg/ml, more than about 15 µg/ml, more than about 20 µg/ml, more than about 25 µg/ml, more than about 30 µg/ml, more than about 40 µg/ml, more than about 50 µg/ml, more than about 100 µg/ml, about 1 µg/ml to about 100 µg/ml, about 1 µg/ml to about 50 µg/ml, about 1 µg/ml to about 25 µg/ml, about 1 µg/ml to about 20 µg/ml, about 1 µg/ml to about 15 µg/ml, about 1 to about 10 µg/ml, about 1 to about 5 µg/ml, about 5 µg/ml to about 100 µg/ml, about 5 µg/ml to about 50 µg/ml, about 5 µg/ml to about 25 µg/ml, about 5 µg/ml to about 20 µg/ml, about 5 µg/ml to about 15 µg/ml, about 5 µg/ml to about 10 µg/ml, about 10 µg/ml to about 100 µg/ml, about 10 µg/ml to about 50 µg/ml, about 10 µg/ml to about 25 µg/ml, about 10 µg/ml to about 20 µg/ml, about 10 µg/ml to about 15 µg/ml, about 15 µg/ml to about 100 µg/ml, about 15 µg/ml to about 50 µg/ml, about 15 µg/ml to about 25 µg/ml, about 15 to about 20 µg/ml, about 20 µg/ml to about 100 µg/ml, about 20 µg/ml to about 50 µg/ml, about 20 µg/ml to about 25 µg/ml, about 25 µg/ml to about 100 µg/ml, about 25 µg/ml to about 50 µg/ml, or about 50 µg/ml to about 100 µg/ml of secreted fusion protein.

Kits

Further provided are kits is one or more of the fusion polypeptides/proteins, polynucleotides, vectors, or host cells, and optionally instructions for manufacture and/or use.

EXPERIMENTAL

Using standard procedures in the art, Applicant initially expressed PTEN-L (SEQ ID NO:3) in bacteria by generating periplasmic and cytoplasmic expression vectors containing the human PTEN-L cDNA tagged in frame with the hexa-histidine (6×His) tag (SEQ ID NO: 222) at the N' or C-terminus. The best orientation was the cytoplasmically targeted N'-term His mutant (FIG. 1). Optimization of the induction conditions failed to materially increase the absolute yield of soluble protein, which remained very low at all times; in addition, the specific activity of the protein in the Malachite Green in vitro phosphatase assay (Spinelli & Leslie, 2015: PMID: 25461809) was low and hardly reproducible (data not shown). Thus, E. coli is not a suitable system to express the PTEN-L tumor suppressor.

Figure 2:
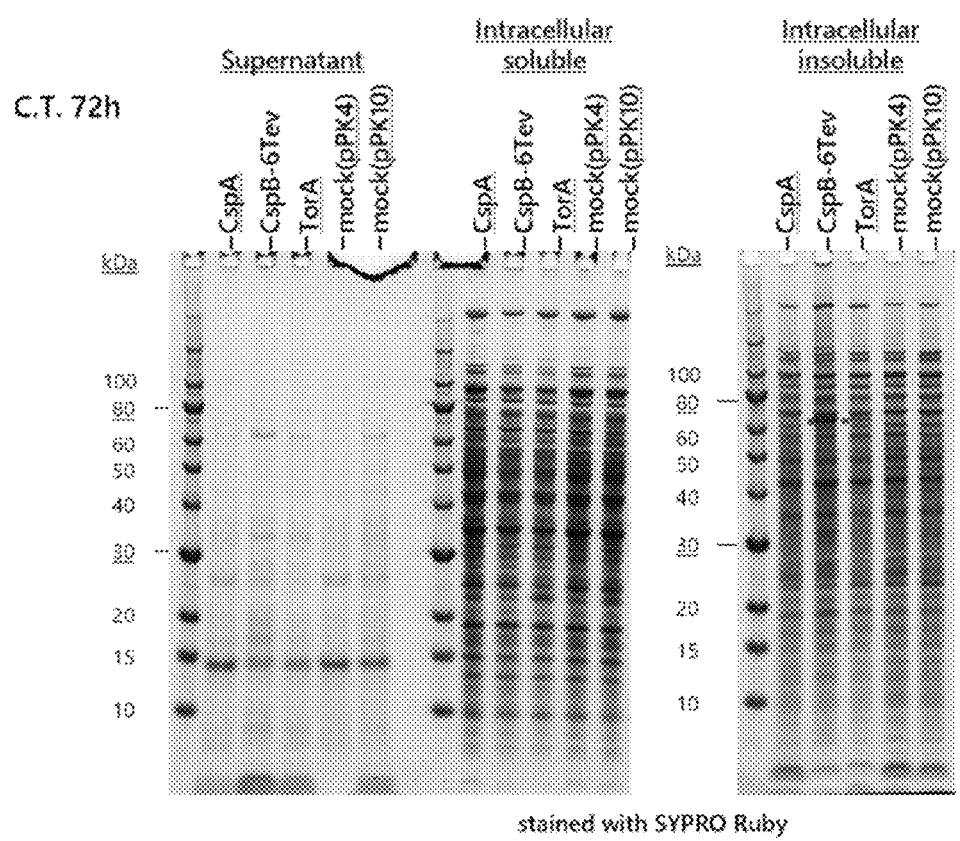
FIG. 2 shows that *Corynebacterium glutamicum* cannot secrete human PTEN-L but instead the protein remains trapped in intracellular inclusion bodies in the cytoplasm.

The human PTEN-L cDNA was sequence-optimized for C. glutamicum expression and cloned in pPK4 and pK10 expression vectors downstream of 3 specific C. glutamicum secretion leader signals (CspA, CspB, TorA), wherein the resulting cDNAs and proteins are listed as SEQ ID NO:41 (CspA-PTEN-L cDNA), SEQ ID NO:42 (CspB-TEV-PTEN-L cDNA), SEQ ID NO:43 (TorA-PTEN-L cDNA), SEQ ID NO:79 (CspA-PTEN-L), SEQ ID NO:80 (CspB-TEV-PTEN-L) and SEQ ID NO:81 (TorA-PTEN-L), respectively. Like in other secretory systems, upon secretion the leader is cleaved and the target protein is released in the C. glutamicum supernatant. (Inclusion of the TEV protease cleavage site can serve to release the wild-type protein if needed, as is known in the art). However, although PTEN-L is expressed in this host, it remains trapped in the intracellular insoluble fraction of these bacteria (FIG. 2, dots) after 72 h in culture and no secretion can be achieved. Hence, C. glutamicum is no better than E. coli, both being unsuitable for industrial manufacturing of the protein.

Figure 3:
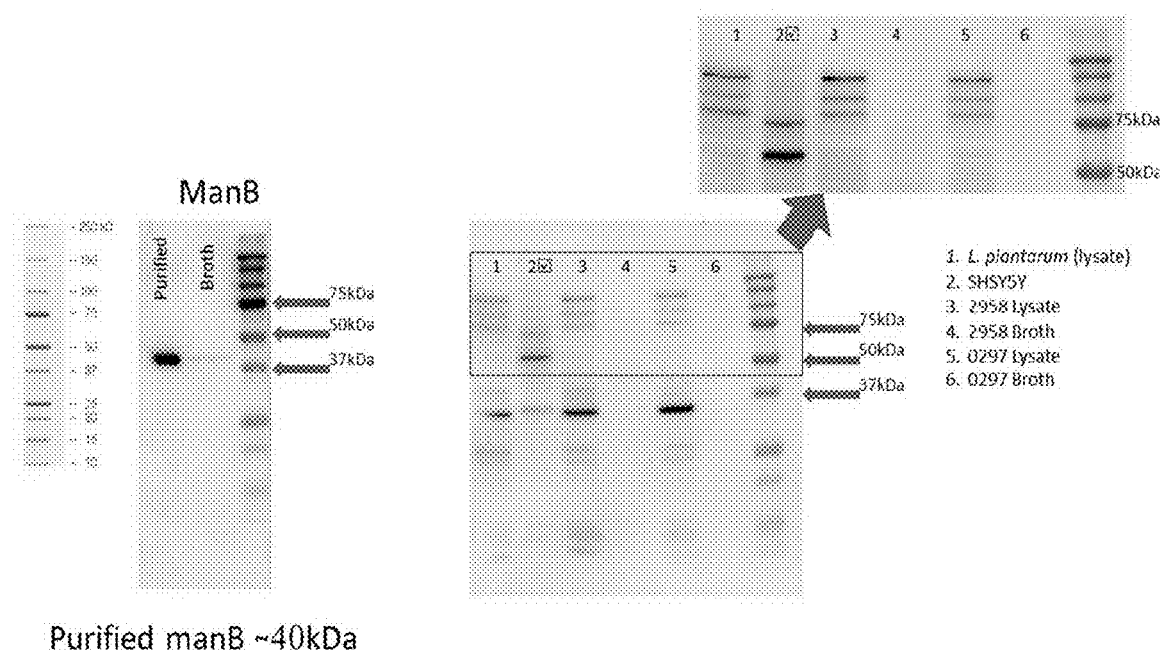
FIG. 3 shows that *Lactobacillus plantarum* can secrete exogenous enzymes like manB but not human PTEN-L.

The Lactobacillus genus of probiotic bacteria is known to be able to secrete heterologous exogenous proteins in the bacterial supernatant. The human PTEN-L cDNA was sequence-optimized for expression in Lactobacillus plantarum and cloned in the pSIP609 L plantarum expression vector (Sak-Ubol et al, 2016; PMID: 27176608), downstream of 6 specific L. plantarum leader secretion signals; shown here are the expression results only for two of the six signals tested, namely the 2958 and 0297 leaders; wherein the corresponding cDNAs and proteins are listed as SEQ ID NO:44 (Lp2958-PTEN-L cDNA), SEQ ID NO:45 (Lp0297-PTEN-L cDNA), SEQ ID NO:82 (Lp2958-PTEN-L) and SEQ ID NO:83 (Lp0297-PTEN-L), respectively (FIG. 3). While exogenous manB protein could be indeed secreted in the L. plantarum supernatant (left), PTEN-L is not at all expressed in this host—not even in the cell lysate (lanes 3-6). As a positive control, mammalian glioma SHSYSY extracts were blotted with a pan-PTEN mAb (F-1) revealing the presence of both PTEN-S (55 KDa) and PTEN-L (70 KDa) in the extracts (lane 2). The various high MW bands seen in the odd lanes are non-specific mAb-reacting L. plantarum proteins that can be observed in both untransformed (lane 1) and pSIP609-transformed cells (lanes 3 and 5). Hence, Lactobacillus plantarum is unsuitable for industrial manufacturing of PTEN-L.

Figure 4:
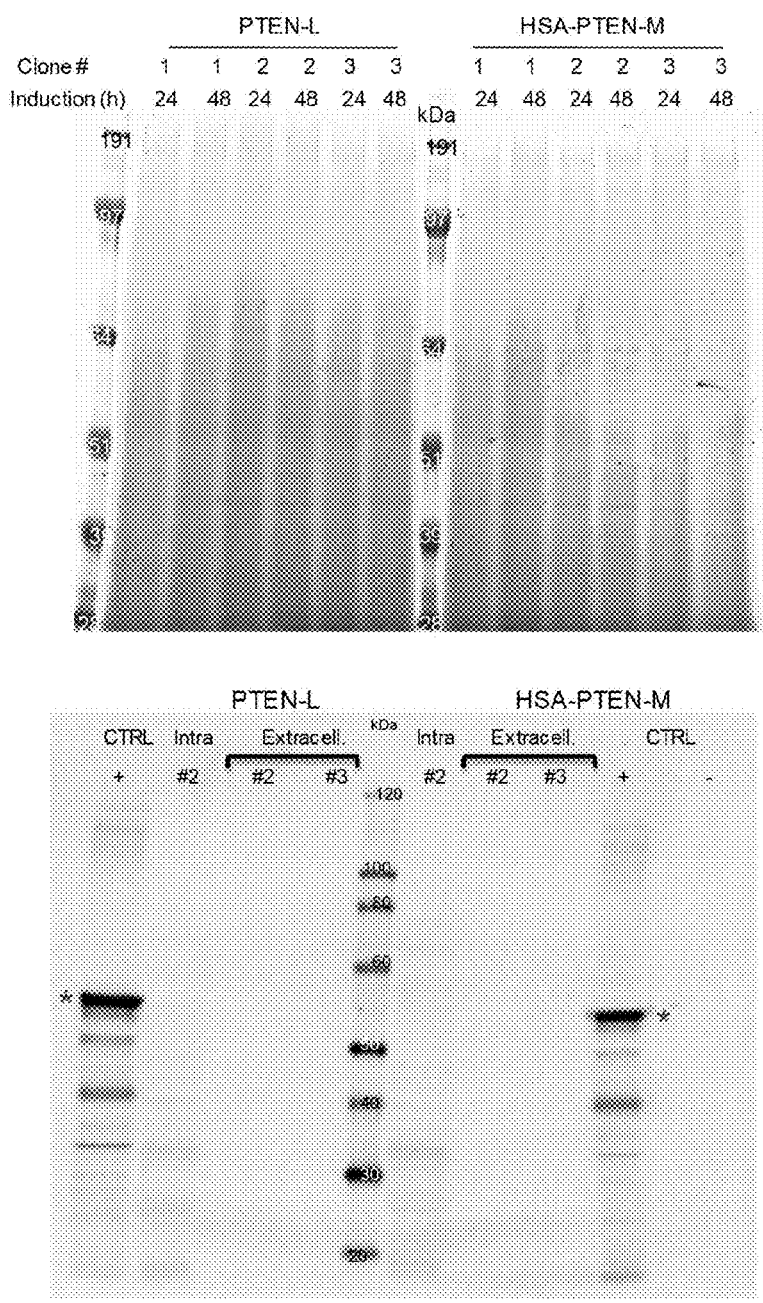
FIG. 4 shows that *Pichia pastoris* cannot make PTEN-L or a human serum albumin-PTEN-M fusion.

A yeast sequence-optimized cDNA comprising a Pichia pastoris-specific signal peptide driving secretion of human albumin-PTEN-M fusion (SEQ ID NO:46) or just the human PTEN-L cDNA (SEQ ID NO:47) were cloned in a P. pastoris expression vector (ATUM Biosciences, San Francisco) and expressed in yeast [the corresponding protein sequences are listed as SEQ ID NO:84 (HSA-PTEN-M) and SEQ ID NO:85 (PTEN-L), respectively]. Gist mutS Pichia pastoris cells were transformed with the vector and the promoter was then induced with 0.5% methanol for 24 h or 48 h. Culture supernatants and cell lysates were loaded on SDS-PAGE (FIG. 4, top) and subsequently western blotted with a LUD-specific PTEN-L mAb (clone 3A4.1, Millipore). However, PTEN-L is neither secreted ("extracellular") nor made in absolute terms ("intracellular" fraction of the cell lysate), whereas the antibody readily detects bacterially expressed PTEN-L (isolated from E. coli inclusion bodies and solubilized in Laemmli buffer; FIG. 4, bottom). Hence, Pichia pastoris is unsuitable for industrial manufacturing of PTEN-L.

Applicant then assessed whether insect Sf9 cells might be able to express a PTEN-M fusion protein mediated by infection with baculovirus carrying the cDNA for the fusion. Accordingly, optimized cDNA sequences encoding for an insect Sf9 cell gp64 secretory signal peptide, humanthioredoxin (Trx), which is known in the art to solubilize difficult-to-express proteins, the TEV protease, the cDNA of the human PTEN-M tumor suppressor and a C-terminal 6×His tag (SEQ ID NO: 222) were synthesized and inserted in frame from 5' to 3 in the pFastBac1 baculovirus expression vector (the optimized cDNA of the fusion is disclosed as SEQ ID NO:86 while the resulting protein sequence as SEQ ID NO:87). Following infection of the Sf9 cells with the virus, performed by standard procedures known in the art, the cDNA is initially expressed into a pre-protein (gp64-Trx-TEV-PTEN-M) fusion, the leader peptide is cleaved and ultimately the Trx-PTEN-M fusion protein is secreted in the culture supernatant. However, no appreciable enrichment was evident in the supernatant of the cells infected with the fusion-encoding virus vs. the negative-control (empty) virus supernatant, as determined by SDS-PAGE (FIG. 5, top panel, lane 1 vs. 5). However, upon western-blotting of these extracts using an anti-6×His antibody (FIG. 5, middle panel), a protein migrating at the expected MW of the secreted fusion (around 80 KDa; green band) could be detected in the cell supernatant but also in both the total and the soluble fraction of the virus-infected cells (green band; FIG. 5, middle panel, lanes 1-3), but not in the corresponding fractions of the empty virus-infected cells (FIG. 5, middle panel lanes 4-6). In addition, the anti-His antibody specifically detects a 65-70 KDa protein band migrating around the expected level of PTEN-L (FIG. 5, middle panel, lanes 1-3 but not 4-8). Infection was subsequently repeated in high volumes, proteins from lane 1 were separated by SDS-PAGE, the 65 KDa band was excised from the gel and sequenced by LC/MS. It was found that the 65 KDa band corresponded to a PTEN-L variant, having the exact sequence of aa (52-576 of SEQ ID NO:1) or human PTEN-L (FIG. 5, lower panel, underlined residues). However, this variant lacks all N' sequences upstream of His52, including the Trx sequences and, more annoyingly, the Minimal Cell Penetration Domain stretch of 6 Arginines (MCPD; SEQ ID NO:39), which is known to mediate 60-80% of cell entry of PTEN-L and PTEN-M (Hopkins et al, 2013: PMID: 23744781; Tzani et al, 2016: PMID: 27249819; Liang et al, 2017: PMID: 28332494). Because there is little specific enrichment of the degradant (SDS-PAGE; lane 1 vs. 4) and the major PTEN-L (65-70 KDa) band has no cell penetration domain, this system is altogether deemed unacceptable for industrial manufacturing of the wild-type cell-penetrating PTEN-L tumor suppressor.

Applicant constructed a battery of mammalian albumin-PTEN fusions in both orientations, as follows (see Table 1 for details):

N'-(SP)(L1)(Albumin)(L2)(PTEN)(L3)-C'
N'-(SP)(L1)(PTEN)(L2)(Albumin)(L3)-C'

Wherein SP is a Signal Peptide selected of SEQ ID NO:4, 93-105.

L1, L2 or L3 are fusion-specific linker sequences.

TABLE 1

| Mutant | Summary Structure | Comments & Notes | SEQ ID | Sequence Type |
|---|---|---|---|---|
| | Human PTEN-L or pre-PTEN-L | | 1 | Protein |
| | Human PTEN-S | | 2 | Protein |
| | Mature human PTEN-L or PTEN-L | | 3 | Protein |
| | Human PTEN-L Signal Peptide | | 4 | Protein |
| | Mature human PTEN-L Unique Domain (LUD) | | 5 | Protein |
| | Human PTEN-M | | 6 | protein |
| | Human PTEN-N | | 7 | protein |
| | Human PTEN-O | | 8 | protein |
| | Human PTEN-M Unique Domain (MUD) | | 9 | protein |
| | Human PTEN-N Unique Domain (NUD) | | 10 | protein |
| | Human PTEN-O Unique Domain (OUD) | | 11 | protein |
| | Human Serum Albumin (HSA) (full length pre-protein) | | 12 | protein |
| | Mature Human Serum Albumin (HSA) (secreted form) | | 13 | protein |
| PR1 | SP(HSA)-HSA-Fu-PTEN-M-6xHis | Furin sensitive linker: SEQ ID NO: 164 | 14 | protein |
| PR2 | SP(HSA)-HSA-MMP2/9-PTEN-M-6xHis | MMP2/9 sensitive linker: SEQ ID NO: 165 | 15 | protein |
| PR3 | SP(HSA)-HSA-PTEN-M-6xHis | | 16 | protein |
| PR5 | SP(HSA)-HSA-MMP2/9-Fu-PTEN-M-6xHis | MMP2/9 & Furin-sensitive linker (SEQ ID NO: 48) | 17 | protein |
| PR6 | SP(HSA)-HSA-PTEN-S-HA tag | HA epitope tag: YPYDVPDYAC (SEQ ID NO: 224) | 18 | protein |
| PR61 | SP(HSA)-HSA-PTEN-S-6xHis | product of SEQ ID 93 + 13 + 2 + 6xHis | 19 | protein |
| PR62 | SP(HSA)-HSA-Fu-PTEN-S-6xHis | Furin sensitive linker: SEQ ID NO: 164 | 20 | protein |
| PR63 | SP(HSA)-HSA-[L(44-59)-L(151-173)]-PTEN-S-6xHis | PTEN-L portions numbered after SEQ ID NO: 1 | 21 | protein |
| PR64 | SP(HSA)-HSA-Fu-[L(44-59)-L(151-173)]-PTEN-S-6xHis | PTEN-L portions numbered after SEQ ID NO: 1 | 22 | protein |
| PR31 | SP(HSA)-HSA-L(43-79)-PTEN-S-6xHis | PTEN-L portions numbered after SEQ ID NO: 1 | 23 | protein |
| PR32 | SP(HSA)-HSA-L(80-120)-PTEN-S-6xHis | PTEN-L portions numbered after SEQ ID NO: 1 | 24 | protein |
| PR33 | SP(HSA)-HSA-L(121-173)-PTEN-S-6xHis | PTEN-L portions numbered after SEQ ID NO: 1 | 25 | protein |
| PR4 | SP(HSA)-PTEN-L-6xHis-MMP2/9-Fu-HSA-Flag | MMP2/9 & Furin-sensitive linker (SEQ ID NO: 48) | 26 | protein |
| PR401 | SP(HSA)-PTEN-L-Fu-HSA-6xHis | Furin sensitive linker: SEQ ID NO: 164 | 27 | protein |
| PR402 | SP(HSA)-PTEN-L-HSA-6xHis | product of SEQ ID 93 + 3 + 13 + 6xHis | 28 | protein |
| PR403 | SP(HSA)-[L(22-27)-L(44-59)-L(151-173)]-PTEN-S-HSA-6xHis | PTEN-L portions numbered after SEQ ID NO: 1 | 29 | protein |
| PR404 | SP(HSA)-[L(22-27)-L(44-59)-L(151-173)]-PTEN-S-Fu-HSA-6xHis | PTEN-L portions numbered after SEQ ID NO: 1; Furin after SEQ ID NO: 164 | 30 | protein |
| PR410 | SP(HSA)-PTEN-L-6xHis | Wild-type human PTEN-L (SEQ NO: 3) tagged with 6xHis ("6xHis" disclosed as SEQ ID NO: 222) | 31 | protein |
| PR411 | SP(IgGκ)-PTEN-L-6xHis | SP(IgGκ) from SEQ ID NO: 101 | 32 | protein |
| PR412 | SP(HSA)-PTEN-L-(3xPro)-6xHis | PTEN-M, N, O initiator aa all mutated to Pro | 33 | protein |
| PR7 | SP(IgGκ)-PTEN-L-6xHis-Fc | SP(IgGκ) = SEQ ID NO: 101; PTEN-L from SEQ ID NO:3; plus wild-type Fc | 34 | protein |
| PR700 | SP(IgGκ)-PTEN-L-6xHis-Fc(N297Q) | Fc(N297Q) is the ADCC-deficient Fc variant | 35 | protein |
| PR8 | SP(IgGκ)-Fc-(GGGGS)-PTEN-M-6xHis | SP(IgGκ) = SEQ ID NO: 101 with Glycine linker fused to SEQ ID NO: 6 | 36 | protein |
| PR911 | SP(HSA)-HA tag-PTEN-S-(GGGG)-PTEN-L(8-173)-PTEN-S-6xHis | MUD sandwiched between 2 PTEN-S domains | 37 | protein |
| F131 | SP(HSA)-HSA-MUD-(GGGGS)-p53-6xHis | domain structure like in PR3 | 38 | protein |
| | Minimal Cell Penetration Domain (MCPD) | RRRRRR (6Arg stretch) | 39 | protein |
| | Membrane Binding Domain (MBD) | corresponds to aa(151-173) of SEQ ID NO: 1 | 40 | protein |

TABLE 1-continued

| Mutant | Summary Structure | Comments & Notes | SEQ ID | Sequence Type |
|---|---|---|---|---|
| | CspA-PTEN-L cDNA | optimized cDNA sequence encoding for protein with SEQ ID NO: 79 | 41 | polynucleotide |
| | CspB-TEV-PTEN-L cDNA | optimized cDNA sequence encoding for protein with SEQ ID NO: 80 | 42 | polynucleotide |
| | TorA-PTEN-L cDNA | optimized cDNA sequence encoding for protein with SEQ ID NO: 81 | 43 | polynucleotide |
| | Lp2958-PTEN-L cDNA | optimized cDNA sequence encoding for protein with SEQ ID NO: 82 | 44 | polynucleotide |
| | Lp0297-PTEN-L cDNA | optimized cDNA sequence encoding for protein with SEQ ID NO: 83 | 45 | polynucleotide |
| | SP(αMF)-HSA-PTEN-M cDNA | optimized cDNA sequence encoding for protein with SEQ ID NO: 84 | 46 | polynucleotide |
| | SP(αMF)-PTEN-L cDNA | optimized cDNA sequence encoding for protein with SEQ ID NO: 85 | 47 | polynucleotide |
| | MMP2/9 & Furin-sensitive linker sequence | GPAALKAATNRRKKRALDAAY | 48 | protein |
| PR430 | Trx-6xHis-UBI-TEV-PTEN-L | TRX = thioredoxin; UBI = ubiquitin (non-cleavable) | 49 | protein |
| PR34 | SP(HSA)-HSA-PTEN-M(ΔR6)-6xHis | like PR3 but without the 6Arg CPD ("6Arg" disclosed as SEQ ID NO: 39) | 50 | protein |
| | Wider Cell Penetration Domain (WCPD) | corresponds to aa(43-79) of SEQ ID NO: 1 | 51 | protein |
| | | corresponds to aa(80-173) of SEQ ID NO: 1 | 52 | protein |
| | Cell Penetration Domain* (CPD*) | corresponds to aa(44-59) of SEQ ID NO: 1 | 53 | protein |
| | PR1 cDNA | optimized cDNA sequence encoding for protein with SEQ ID NO: 14 | 54 | polynucleotide |
| | PR2 cDNA | optimized cDNA sequence encoding for protein with SEQ ID NO: 15 | 55 | polynucleotide |
| | PR3 cDNA | optimized cDNA sequence encoding for protein with SEQ ID NO: 16 | 56 | polynucleotide |
| | PR5 cDNA | optimized cDNA sequence encoding for protein with SEQ ID NO: 17 | 57 | polynucleotide |
| | PR6 cDNA | optimized cDNA sequence encoding for protein with SEQ ID NO: 18 | 58 | polynucleotide |
| | PR61 cDNA | optimized cDNA sequence encoding for protein with SEQ ID NO: 19 | 59 | polynucleotide |
| | PR62 cDNA | optimized cDNA sequence encoding for protein with SEQ ID NO: 20 | 60 | polynucleotide |
| | PR63 cDNA | optimized cDNA sequence encoding for protein with SEQ ID NO: 21 | 61 | polynucleotide |
| | PR64 cDNA | optimized cDNA sequence encoding for protein with SEQ ID NO: 22 | 62 | polynucleotide |
| | PR31 cDNA | optimized cDNA sequence encoding for protein with SEQ ID NO: 23 | 63 | polynucleotide |
| | PR32 cDNA | optimized cDNA sequence encoding for protein with SEQ ID NO: 24 | 64 | polynucleotide |
| | PR33 cDNA | optimized cDNA sequence encoding for protein with SEQ ID NO: 25 | 65 | polynucleotide |
| | PR4 cDNA | optimized cDNA sequence encoding for protein with SEQ ID NO: 26 | 66 | polynucleotide |
| | PR401 cDNA | optimized cDNA sequence encoding for protein with SEQ ID NO: 27 | 67 | polynucleotide |

TABLE 1-continued

| Mutant | Summary Structure | Comments & Notes | SEQ ID | Sequence Type |
|---|---|---|---|---|
| | PR402 cDNA | optimized cDNA sequence encoding for protein with SEQ ID NO: 28 | 68 | polynucleotide |
| | PR403 cDNA | optimized cDNA sequence encoding for protein with SEQ ID NO: 29 | 69 | polynucleotide |
| | PR404 cDNA | optimized cDNA sequence encoding for protein with SEQ ID NO: 30 | 70 | polynucleotide |
| | PR410 cDNA | optimized cDNA sequence encoding for protein with SEQ ID NO: 31 | 71 | polynucleotide |
| | PR411 cDNA | optimized cDNA sequence encoding for protein with SEQ ID NO: 32 | 72 | polynucleotide |
| | PR412 cDNA | optimized cDNA sequence encoding for protein with SEQ ID NO: 33 | 73 | polynucleotide |
| | PR7 cDNA | optimized cDNA sequence encoding for protein with SEQ ID NO: 34 | 74 | polynucleotide |
| | PR700 cDNA | optimized cDNA sequence encoding for protein with SEQ ID NO: 35 | 75 | polynucleotide |
| | PR8 cDNA | optimized cDNA sequence encoding for protein with SEQ ID NO: 36 | 76 | polynucleotide |
| | PR911 cDNA | optimized cDNA sequence encoding for protein with SEQ ID NO: 37 | 77 | polynucleotide |
| | F131 cDNA | optimized cDNA sequence encoding for protein with SEQ ID NO: 38 | 78 | polynucleotide |
| | CspA-PTEN-L | C. glutamicum CspA signal peptide driving secretion of human PTEN-L | 79 | protein |
| | CspB-TEV-PTEN-L | C. glutamicum CspB signal peptide driving secretion of human PTEN-L w/TEV | 80 | protein |
| | TorA-PTEN-L | C. glutamicum TorA signal peptide driving secretion of human PTEN-L | 81 | protein |
| | Lp2958-PTEN-L | Lactobacillus Lp2958 signal peptide driving human PTEN-L secretion | 82 | protein |
| | Lp0297-PTEN-L | Lactobacillus Lp0297 signal peptide driving human PTEN-L secretion | 83 | protein |
| | SP(αMF)-HSA-PTEN-M | yeast alpha mating factor signal peptide driving human HSA-PTEN-M secretion | 84 | protein |
| | SP(αMF)-PTEN-L | yeast alpha mating factor signal peptide driving human PTEN-L secretion | 85 | protein |
| | Gp64-Trx-TEV-PTEN-M-6xHis cDNA | optimized cDNA sequence encoding for protein with SEQ ID NO: 87 | 86 | polynucleotide |
| | Gp64-Trx-TEV-PTEN-M-6xHis | Sf9 signal peptide driving Thioredoxin-PTEN-M fusion; cleavable by TEV protease | 87 | protein |
| | Mouse PTEN-S | | 88 | protein |
| | Mature mouse PTEN-L | | 89 | protein |
| | Mature Simian Serum Albumin (SSA) | | 90 | protein |
| | Mature Rat Serum Albumin (RSA) | | 91 | protein |
| | Mature Mouse Serum Albumin (MSA) | | 92 | protein |
| | Signal Peptide of Human Serum Albumin | | 93 | protein |
| | Signal Peptide of Simian Serum Albumin | | 94 | protein |
| | Signal Peptide of Rat Serum Albumin | | 95 | protein |
| | Signal Peptide of Mouse Serum Albumin | | 96 | protein |
| | Signal Peptide of murine α2-macroglobulin | | 97 | protein |

TABLE 1-continued

| Mutant | Summary Structure | Comments & Notes | SEQ ID | Sequence Type |
|---|---|---|---|---|
| | Signal Peptide of murine fibrinogen | | 98 | protein |
| | Signal Peptide of murine α1-antitrypsin | | 99 | protein |
| | Signal Peptide of murine IgGκ chain | | 100 | protein |
| | Signal Peptide of human IgGκ heavy chain | | 101 | protein |
| | Signal Peptide of human IgGκ chain | | 102 | protein |
| | Human Siglec 3 (CD33) Signal Peptide | | 103 | protein |
| | Artificial Signal Peptide (Secrecon) | from Güler-Gane et al, 2016 | 104 | protein |
| | Artificial Signal Peptide (Boosted Secrecon) | from Güler-Gane et al, 2016 | 105 | protein |
| | Cathepsin B-sensitive linker sequence | GGAGS | 106 | protein |
| | Cathepsin B-sensitive linker sequence | GFVG | 107 | protein |
| | Cathepsin B-sensitive linker sequence | FGFVG | 108 | protein |
| PR419 | SP(SEQ ID NO: 97)-PTEN-L-HSA-6xHis | PR402 secreted via the Signal Peptide of murine α2-macroglobulin | 109 | protein |
| PR420 | SP(SEQ ID NO: 98)-PTEN-L-HSA-6xHis | PR402 secreted via the Signal Peptide of murine fibrinogen | 110 | protein |
| PR421 | SP(SEQ ID NO: 99)-PTEN-L-HSA-6xHis | PR402 secreted via the Signal Peptide of murine α1-antitrypsin | 111 | protein |
| PR422 | SP(SEQ ID NO: 100)-PTEN-L-HSA-6xHis | PR402 secreted via the Signal Peptide of murine IgGκ chain | 112 | protein |
| PR424 | SP(SEQ ID NO: 102)-PTEN-L-HSA-6xHis | PR402 secreted via the Signal Peptide of human IgGκ chain | 113 | protein |
| PR425 | SP(SEQ ID NO: 103)-PTEN-L-HSA-6xHis | PR402 secreted via the Human Siglec 3 (CD33) Signal Peptide | 114 | protein |
| PR426 | SP(SEQ ID NO: 104)-PTEN-L-HSA-6xHis | PR402 secreted via the Artificial Signal Peptide (Secrecon) | 115 | protein |
| PR427 | SP(SEQ ID NO: 105)-PTEN-L-HSA-6xHis | PR402 secreted via the Artificial Signal Peptide (Boosted Secrecon) | 116 | protein |
| PR428 | SP(MSA)-muPTEN-L-MSA-6xHis | mouse PR402; product of SEQ ID NOs: 96 + 89 + 92 + 6xHis | 117 | protein |
| PR409 | SP(HSA)-HAtag-PTEN-L-HSA-6xHis | N-term HA tagged PR402 | 118 | protein |
| PR415 | SP(HSA)-PTEN-L-HSA(C345) | identical to PR402 but for scavenger HSA Cys34 and lack of 6xHis ("6xHis" disclosed as SEQ ID NO: 222) | 119 | protein |
| PR416 | SP(HSA)-PTEN-M-HSA(C345) | scavenger HSA Cys34 mutated | 120 | protein |
| PR413 | SP(HSA)-PTEN-L-HSA(1-385)-6xHis | PR402 bearing a HSA(1-385) or ΔdIII albumin deletion mutant | 121 | protein |
| PR414 | SP(HSA)-PTEN-L-HSA(1-197)-6xHis | PR402 bearing a HSA(1-197) or ΔdII & ΔdIII albumin deletion mutant | 122 | protein |
| PR417 | SP(HSA)-PTEN-L-HSA(35-585)-6xHis | PR402 bearing an N-terminal HSA deletion mutant | 123 | protein |
| PR418 | SP(HSA)-PTEN-L-HSA(63-585)-6xHis | PR402 bearing an N-terminal HSA deletion mutant | 124 | protein |
| PR65 | SP(HSA)-PTEN-S(2-403)-HSA-6xHis | inverse orientation of PR6 and PR61 | 125 | protein |
| PR66 | SP(MSA)-RSA-mouse PTEN-S(2-403)-6xHis | rat PR61 equivalent | 126 | protein |
| PR67 | SP(MSA)-RSA(1-381)-mouse PTEN-S(2-403)-6xHis | PR68 ΔdIII HSA | 127 | protein |
| PR68 | SP(MSA)-MSA-mouse PTEN-S(2-403)-6xHis | mouse PR61 equivalent | 128 | protein |
| PR405 | SP(HSA)-PTEN-L-MMP2/9-HSA-6xHis | PR402 with SEQ ID NO: 49 inserted in frame between the two domains | 129 | protein |
| PR406 | SP(HSA)-PTEN-L-cathepsin B-HSA-6xHis | PR402 with SEQ ID NO: 106 inserted in frame between the two domains | 130 | protein |
| PR407 | SP(HSA)-PTEN-L-cathepsin B*-HSA-6xHis | PR402 with SEQ ID NO: 107 inserted in frame between the two domains | 131 | protein |
| PR408 | SP(HSA)-PTEN-L-cathepsinB**-HSA-6xHis | PR402 with SEQ ID NO: 108 inserted in frame between the two domains | 132 | protein |
| F137 | SP(HSA)-LUD-p53-HSA-6xHis | domain structure like in PR402 | 133 | protein |
| | Mutated Human LUD with sialyl-like charges | see FIG. 19 | 134 | protein |

TABLE 1-continued

| Mutant | Summary Structure | Comments & Notes | SEQ ID | Sequence Type |
|---|---|---|---|---|
| | PR430 cDNA | optimized cDNA sequence encoding for protein with SEQ ID NO: 49 | 135 | polynucleotide |
| | PR34 cDNA | optimized cDNA sequence encoding for protein with SEQ ID NO: 50 | 136 | polynucleotide |
| | PR419 cDNA | optimized cDNA sequence encoding for protein with SEQ ID NO: 109 | 137 | polynucleotide |
| | PR420 cDNA | optimized cDNA sequence encoding for protein with SEQ ID NO: 110 | 138 | polynucleotide |
| | PR421 cDNA | optimized cDNA sequence encoding for protein with SEQ ID NO: 111 | 139 | polynucleotide |
| | PR422 cDNA | optimized cDNA sequence encoding for protein with SEQ ID NO: 112 | 140 | polynucleotide |
| | PR424 cDNA | optimized cDNA sequence encoding for protein with SEQ ID NO: 113 | 141 | polynucleotide |
| | PR425 cDNA | optimized cDNA sequence encoding for protein with SEQ ID NO: 114 | 142 | polynucleotide |
| | PR426 cDNA | optimized cDNA sequence encoding for protein with SEQ ID NO: 115 | 143 | polynucleotide |
| | PR427 cDNA | optimized cDNA sequence encoding for protein with SEQ ID NO: 116 | 144 | polynucleotide |
| | PR428 cDNA | optimized cDNA sequence encoding for protein with SEQ ID NO: 117 | 145 | polynucleotide |
| | PR409 cDNA | optimized cDNA sequence encoding for protein with SEQ ID NO: 118 | 146 | polynucleotide |
| | PR415 cDNA | optimized cDNA sequence encoding for protein with SEQ ID NO: 119 | 147 | polynucleotide |
| | PR416 cDNA | optimized cDNA sequence encoding for protein with SEQ ID NO: 120 | 148 | polynucleotide |
| | PR413 cDNA | optimized cDNA sequence encoding for protein with SEQ ID NO: 121 | 149 | polynucleotide |
| | PR414 cDNA | optimized cDNA sequence encoding for protein with SEQ ID NO: 122 | 150 | polynucleotide |
| | PR417 cDNA | optimized cDNA sequence encoding for protein with SEQ ID NO: 123 | 151 | polynucleotide |
| | PR418 cDNA | optimized cDNA sequence encoding for protein with SEQ ID NO: 124 | 152 | polynucleotide |
| | PR65 cDNA | optimized cDNA sequence encoding for protein with SEQ ID NO: 125 | 153 | polynucleotide |
| | PR66 cDNA | optimized cDNA sequence encoding for protein with SEQ ID NO: 126 | 154 | polynucleotide |
| | PR67 cDNA | optimized cDNA sequence encoding for protein with SEQ ID NO: 127 | 155 | polynucleotide |
| | PR68 cDNA | optimized cDNA sequence encoding for protein with SEQ ID NO: 128 | 156 | polynucleotide |
| | PR405 cDNA | optimized cDNA sequence encoding for protein with SEQ ID NO: 129 | 157 | polynucleotide |
| | PR406 cDNA | optimized cDNA sequence encoding for protein with SEQ ID NO: 130 | 158 | polynucleotide |
| | PR407 cDNA | optimized cDNA sequence encoding for protein with SEQ ID NO: 131 | 159 | polynucleotide |

TABLE 1-continued

| Mutant | Summary Structure | Comments & Notes | SEQ ID | Sequence Type |
|---|---|---|---|---|
| | PR408 cDNA | optimized cDNA sequence encoding for protein with SEQ ID NO: 132 | 160 | polynucleotide |
| | F137 cDNA | optimized cDNA sequence encoding for protein with SEQ ID NO: 133 | 161 | polynucleotide |
| | Minimal Mouse/Rat/Human PTEN-S | aa(8-351) of PTEN-S; identical in rodents & primates | 162 | protein |
| | Minimal Human Serum Albumin | aa(63-385) of SEQ ID NO: 13 | 163 | protein |
| | Furin Sensitive Linker Sequence | TNRRKKRALDAAY | 164 | protein |
| | MMP2/9-Sensitive Linker Sequence | GPAALKAA | 165 | protein |
| | Mouse PTEN-S cDNA | optimized cDNA sequence encoding for protein with SEQ ID NO: 88 | 166 | polynucleotide |
| | Mature mouse PTEN-L cDNA | optimized cDNA sequence encoding for protein with SEQ ID NO: 89 | 167 | polynucleotide |
| | Wider Cell Penetration Domain (WCPD) cDNA | cDNA of SEQ ID NO: 51 | 168 | polynucleotide |
| | Minimal Cell Penetration Domain cDNA | cDNA of SEQ ID NO: 52 | 169 | polynucleotide |
| | Cell Penetration Domain* (CPD*) cDNA | cDNA of SEQ ID NO: 53 | 170 | polynucleotide |
| | Human PTEN-L or pre-PTEN-L cDNA | optimized cDNA sequence encoding for protein with SEQ ID NO: 1 | 171 | polynucleotide |
| | Human PTEN-S cDNA | optimized cDNA sequence encoding for protein with SEQ ID NO: 2 | 172 | polynucleotide |
| | pTT5 mammalian expression vector cDNA | complete sequence of pTT5 empty vector | 173 | polynucleotide |
| | L. plantarum expression vector cDNA | complete sequence of recombinant pSIP609-Lp2958-PTEN-L (SEQ ID NO: 82) | 174 | polynucleotide |
| | P. pastoris expression vector cDNA | complete sequence of recombinant SP(αMF)-PTEN-L (SEQ ID NO: 85) | 175 | polynucleotide |
| | cDNA of Mature Human Serum Albumin (HSA) | optimized cDNA sequence encoding for protein with SEQ ID NO: 13 | 176 | polynucleotide |
| | cDNA of Mature Simian Serum Albumin (SSA) | optimized cDNA sequence encoding for protein with SEQ ID NO: 90 | 177 | polynucleotide |
| | cDNA of Mature Rat Serum Albumin (RSA) | optimized cDNA sequence encoding for protein with SEQ ID NO: 91 | 178 | polynucleotide |
| | cDNA of Mature Mouse Serum Albumin (MSA) | optimized cDNA sequence encoding for protein with SEQ ID NO: 92 | 179 | polynucleotide |
| | cDNA of Signal Peptide of Human Serum Albumin | optimized cDNA sequence encoding for protein with SEQ ID NO: 93 | 180 | polynucleotide |
| | cDNA of Signal Peptide of Simian Serum Albumin | optimized cDNA sequence encoding for protein with SEQ ID NO: 94 | 181 | polynucleotide |
| | cDNA of Signal Peptide of Rat Serum Albumin | optimized cDNA sequence encoding for protein with SEQ ID NO: 95 | 182 | polynucleotide |
| | cDNA of Signal Peptide of Mouse Serum Albumin | optimized cDNA sequence encoding for protein with SEQ ID NO: 96 | 183 | polynucleotide |
| | cDNA of Signal Peptide of murine α2-macroglobulin | optimized cDNA sequence encoding for protein with SEQ ID NO: 97 | 184 | polynucleotide |
| | cDNA of Signal Peptide of murine fibrinogen | optimized cDNA sequence encoding for protein with SEQ ID NO: 98 | 185 | polynucleotide |
| | cDNA of Signal Peptide of murine α1-antitrypsin | optimized cDNA sequence encoding for protein with SEQ ID NO: 99 | 186 | polynucleotide |
| | cDNA of Signal Peptide of murine IgGκ chain | optimized cDNA sequence encoding for protein with SEQ ID NO: 100 | 187 | polynucleotide |
| | cDNA of Signal Peptide of human IgG heavy chain | optimized cDNA sequence encoding for protein with SEQ ID NO: 101 | 188 | polynucleotide |

TABLE 1-continued

| Mutant | Summary Structure | Comments & Notes | SEQ ID | Sequence Type |
|---|---|---|---|---|
| | cDNA of Signal Peptide of human IgGκ chain | optimized cDNA sequence encoding for protein with SEQ ID NO: 102 | 189 | polynucleotide |
| | cDNA of Human Siglec 3 (CD33) Signal Peptide | optimized cDNA sequence encoding for protein with SEQ ID NO: 103 | 190 | polynucleotide |
| | cDNA of Artificial Signal Peptide (Secrecon) | optimized cDNA sequence encoding for protein with SEQ ID NO: 104 | 191 | polynucleotide |
| | cDNA of Artificial Signal Peptide (Boosted Secrecon) | optimized cDNA sequence encoding for protein with SEQ ID NO: 105 | 192 | polynucleotide |
| | Mature human PTEN-L Unique Domain (LUD) cDNA | optimized cDNA sequence encoding for protein with SEQ ID NO: 5 | 193 | polynucleotide |
| | Human PTEN-M Unique Domain (MUD) cDNA | optimized cDNA sequence encoding for protein with SEQ ID NO: 9 | 194 | polynucleotide |
| | Human PTEN-N Unique Domain (NUD) cDNA | optimized cDNA sequence encoding for protein with SEQ ID NO: 10 | 195 | polynucleotide |
| | Human PTEN-O Unique Domain (OUD) cDNA | optimized cDNA sequence encoding for protein with SEQ ID NO: 11 | 196 | polynucleotide |
| | Minimal Mouse/Rat/Human PTEN-S cDNA | optimized cDNA sequence encoding for protein with SEQ ID NO: 162 | 197 | polynucleotide |
| | Human PTEN-M cDNA | optimized cDNA sequence encoding for protein with SEQ ID NO: 6 | 198 | polynucleotide |
| | Human PTEN-N cDNA | optimized cDNA sequence encoding for protein with SEQ ID NO: 7 | 199 | polynucleotide |
| | Human PTEN-O cDNA | optimized cDNA sequence encoding for protein with SEQ ID NO: 8 | 200 | polynucleotide |
| | Mouse PTEN-M | | 201 | protein |
| | Mouse PTEN-N | | 202 | protein |
| | Mouse PTEN-O | | 203 | protein |
| | Mouse PTEN-M cDNA | optimized cDNA sequence encoding for protein with SEQ ID NO: 201 | 204 | polynucleotide |
| | Mouse PTEN-N cDNA | optimized cDNA sequence encoding for protein with SEQ ID NO: 202 | 205 | polynucleotide |
| | Mouse PTEN-O cDNA | optimized cDNA sequence encoding for protein with SEQ ID NO: 203 | 206 | polynucleotide |
| | miR21 primer for Reverse Transcription (5' > 3') | | 207 | polynucleotide |
| | miR21 forward primer (5' > 3') | | 208 | polynucleotide |
| | miR21 reverse primer (5' > 3') | | 209 | polynucleotide |
| | pAdEasy-1 complete sequence | | 210 | polynucleotide |
| | pAd(dps)ΔCU-IRES-E1A | | 211 | polynucleotide |
| | 47upF | | 212 | polynucleotide |
| | 47upR | | 213 | polynucleotide |
| | 47dnF | | 214 | polynucleotide |
| | 47dnR | | 215 | polynucleotide |
| | complementary linker 1 | | 216 | polynucleotide |
| | complementary linker 2 | | 217 | polynucleotide |
| | 345upF | | 218 | polynucleotide |
| | 345upR | | 219 | polynucleotide |
| | 345dnF | | 220 | polynucleotide |
| | 345dnR | | 221 | polynucleotide |

Figure 6A:
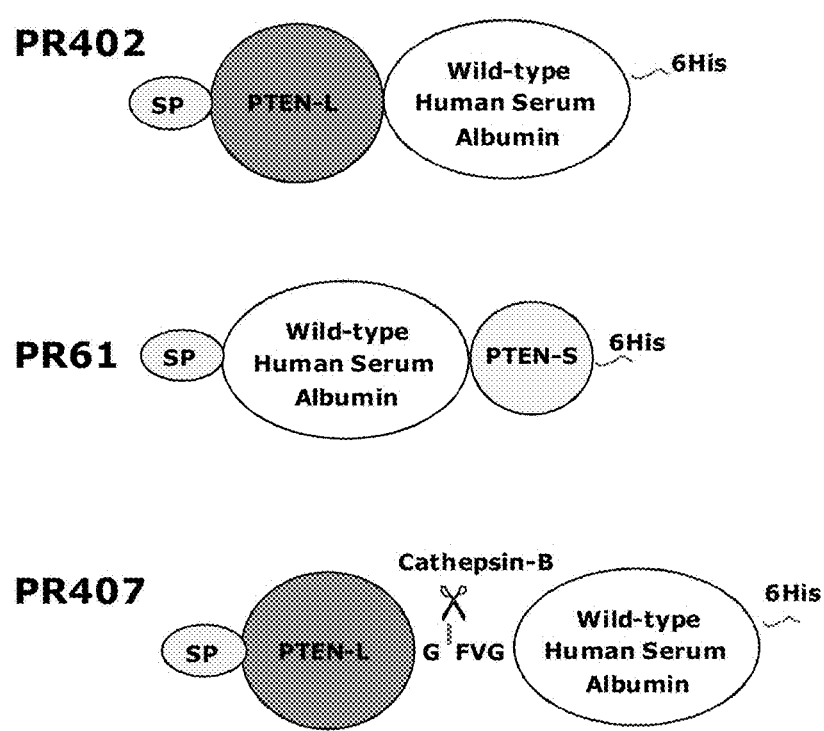
Figure 6C:
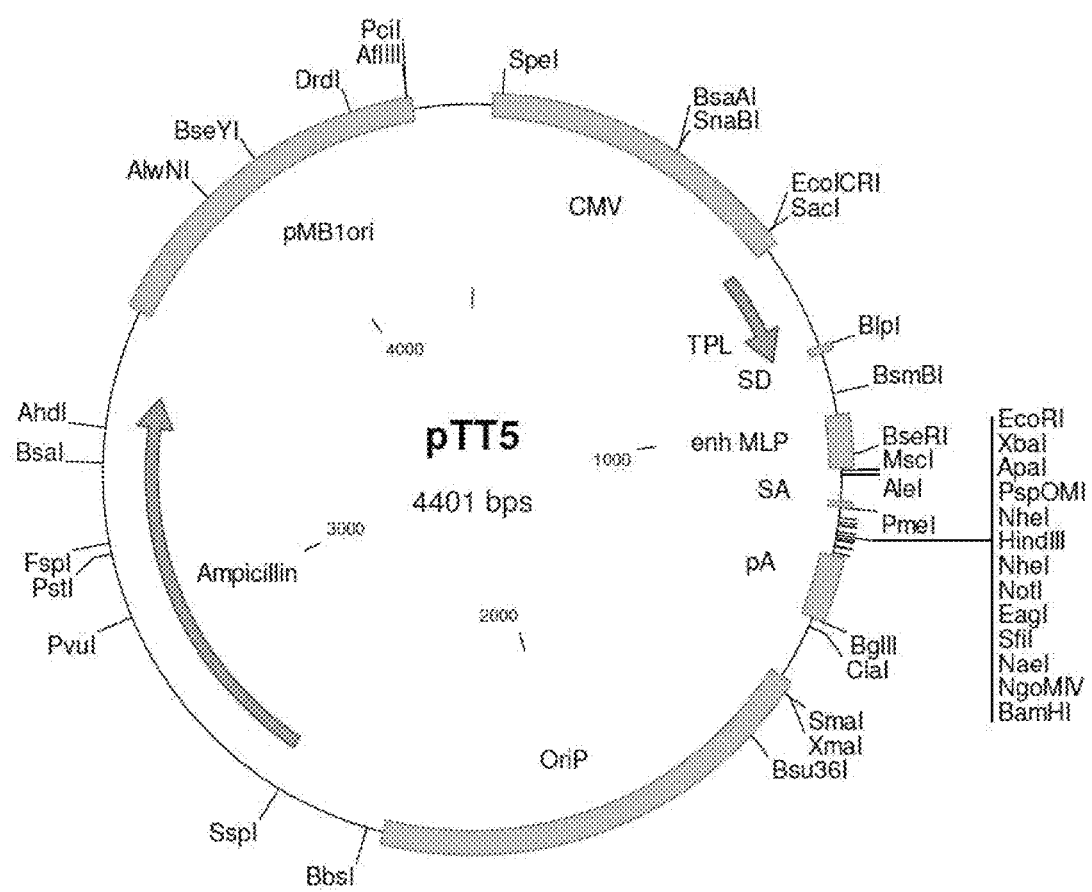
Figure 6D:
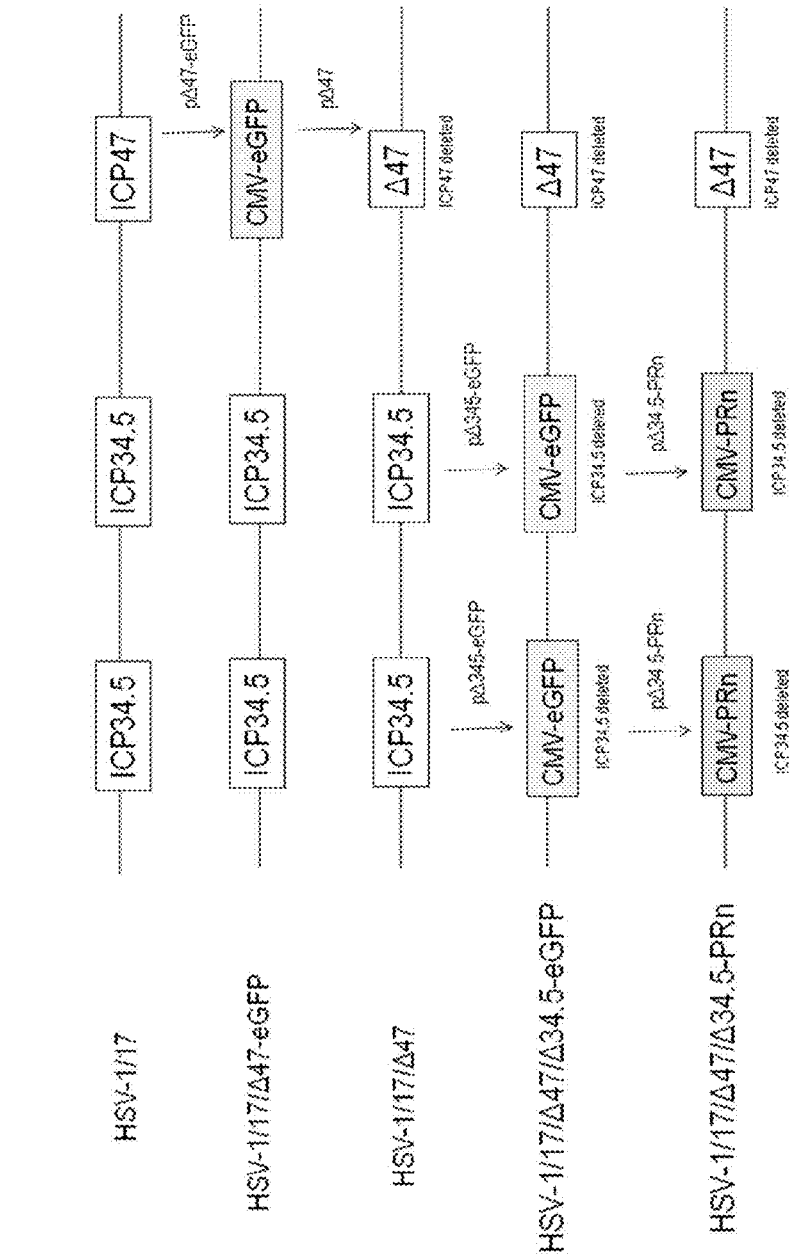

In some embodiments, linker sequences may be omitted or may comprise or even consist of epitope tags, selected of 6×His (SEQ ID NO: 222), Flag hemagglutinin (HA) and other similar tags, as shown (FIG. 6A&Table 1).

In some embodiments, the aforementioned fusion PTEN proteins contain epitope tags. In other embodiments, the aforementioned fusion PTEN proteins contain no epitope tags.

Albumin is HSA, SSA, RSA or MSA selected of SEQ ID NO:12, 13 or SEQ ID NO:90-92, or SEQ ID NO:163, or an equivalent, deletion mutant, point mutant, analog or variant of each thereof.

PTEN is a PTEN protein selected of SEQ ID NO:2-3; or SEQ ID NO:6-8 or SEQ ID:88-89, or SEQ ID NO:162, or an equivalent, deletion mutant, point mutant, analog or variant of each thereof.

In one embodiment, the following PTEN-L variants were created: PR410 (SEQ ID NO:31; cDNA SEQ ID NO:71), PR411 (SEQ ID NO:32; cDNA SEQ ID NO:72), PR412 (SEQ ID NO:33; cDNA SEQ ID NO:73).

In another embodiment, the following N'-PTEN-L-Fc-C' fusions were created: PR7 (SEQ ID NO:34; cDNA, 5'-PTEN-L-Fc-3', SEQ ID NO:74), PR700 (SEQ ID NO:35; cDNA, 5'-PTEN-L-Fc-3', SEQ ID NO:75).

In another embodiment, the following N'-Fc-PTEN-L-C' fusion was created: PR8 (SEQ ID NO:36; cDNA, 5'-Fc-PTEN-L-3', SEQ ID NO:76).

In another embodiment, the following N'-Thioredoxin-PTEN-L-C' fusion was created: PR430 (SEQ ID NO:49; cDNA, 5'-Thioredoxin-PTEN-L-3',SEQ ID NO: 135).

In another embodiment, the following N'-albumin-PTEN-C' fusions were created: PR1 (SEQ ID NO:14; cDNA, 5'-albumin-PTEN-3', SEQ ID NO:54), PR2 (SEQ ID NO:15; cDNA, 5'-albumin-PTEN-3', SEQ ID NO:55), PR3 (SEQ ID NO:16; cDNA, 5'-albumin-PTEN-3', SEQ ID NO:56), PR5 (SEQ ID NO:17; cDNA, 5'-albumin-PTEN-3', SEQ ID NO:57), PR63 (SEQ ID NO:21; cDNA, 5'-albumin-PTEN-3', SEQ ID NO:61), PR64 (SEQ ID NO:22; cDNA, 5'-albumin-PTEN-3', SEQ ID NO:62), PR31 (SEQ ID NO:23; cDNA, 5'-albumin-PTEN-3', SEQ ID NO:63), PR32 (SEQ ID NO:24; cDNA, 5'-albumin-PTEN-3', SEQ ID NO:64), PR33 (SEQ ID NO:25; cDNA, 5'-albumin-PTEN-3', SEQ ID NO:65), PR34 (SEQ ID NO:50; cDNA, 5'-albumin-PTEN-3', SEQ ID NO:136).

In another embodiment, the following N'-PTEN-L-albumin-C' fusions were created: PR4 (SEQ ID NO:26; cDNA, 5'-PTEN-L-albumin-3', SEQ ID NO:66), PR401 (SEQ ID NO:27; cDNA, 5'-PTEN-L-albumin-3', SEQ ID NO:67), PR402 (SEQ ID NO:28; cDNA, 5'-PTEN-L-albumin-3', SEQ ID NO:68), PR403 (SEQ ID NO:29; cDNA, 5'-PTEN-L-albumin-3', SEQ ID NO:69), PR404 (SEQ ID NO:30; cDNA, 5'-PTEN-L-albumin-3', SEQ ID NO:70). In a further embodiment, created is a fusion protein comprising a N' terminal minimal PTEN domain and a C' terminal albumin. In yet a further embodiment, the minimal PTEN domain comprises an amino acid sequence of SEQ ID NO: 162. Additionally or alternatively, the albumin is an HSA and the fusion protein further comprises an HSA signal peptide and a 6×His tag (SEQ ID NO: 222).

In another embodiment, the following N'-PTEN-L-albumin-C' fusions were created: PR419 (SEQ ID NO:109; cDNA, 5'-PTEN-L-albumin-3', SEQ ID NO:137), PR420 (SEQ ID NO:110; cDNA, 5'-PTEN-L-albumin-3', SEQ ID NO:138), PR421 (SEQ ID NO:111; cDNA, 5'-PTEN-L-albumin-3', SEQ ID NO:139), PR422 (SEQ ID NO:112; cDNA, 5'-PTEN-L-albumin-3', SEQ ID NO:140), PR424 (SEQ ID NO:113; cDNA, 5'-PTEN-L-albumin-3', SEQ ID NO:141), PR425 (SEQ ID NO:114; cDNA, 5'-PTEN-L-albumin-3', SEQ ID NO:142), PR426 (SEQ ID NO:115; cDNA, 5'-PTEN-L-albumin-3', SEQ ID NO:143), PR427 (SEQ ID NO:116; cDNA, 5'-PTEN-L-albumin-3', SEQ ID NO:144), PR428 (SEQ ID NO:117; cDNA, 5'-PTEN-L-albumin-3', SEQ ID NO:145), PR409 (SEQ ID NO:118; cDNA, 5'-PTEN-L-albumin-3', SEQ ID NO:146), PR415 (SEQ ID NO:119; cDNA, 5'-PTEN-L-albumin-3', SEQ ID NO:147), PR416 (SEQ ID NO:120; cDNA, 5'-PTEN-L-albumin-3', SEQ ID NO:148), PR413 (SEQ ID NO:121; cDNA, 5'-PTEN-L-albumin-3', SEQ ID NO:149), PR414 (SEQ ID NO:122; cDNA, 5'-PTEN-L-albumin-3', SEQ ID NO:150), PR417 (SEQ ID NO:123; cDNA, 5'-PTEN-L-albumin-3', SEQ ID NO:151), and PR418 (SEQ ID NO:124; cDNA, 5'-PTEN-L-albumin-3', SEQ ID NO:152).

In another embodiment, the following N'-albumin-PTEN-C' fusions were created: PR6 (SEQ ID NO:18; cDNA, 5'-albumin-PTEN-3', SEQ ID NO:58), PR61 (SEQ ID NO:19; cDNA, 5'-albumin-PTEN-3', SEQ ID NO:59), PR62 (SEQ ID NO:20; cDNA, 5'-albumin-PTEN-3', SEQ ID NO:60), PR66 (SEQ ID NO:126; cDNA, 5'-albumin-PTEN-3', SEQ ID NO:154), PR67 (SEQ ID NO:127; cDNA, 5'-albumin-PTEN-3', SEQ ID NO:155) and PR68 (SEQ ID NO:128; cDNA, 5'-albumin-PTEN-3', SEQ ID NO:156). In a further embodiment, created is a fusion protein comprising a N' terminal albumin and a C' terminal minimal PTEN domain. In yet a further embodiment, the minimal PTEN domain comprises an amino acid sequence of SEQ ID NO: 162. Additionally or alternatively, the albumin is an HSA and the fusion protein further comprises an HSA signal peptide and a 6×His tag (SEQ ID NO: 222).

In another embodiment, the following N'-PTEN-S-albumin-C' fusion was created: PR65 (SEQ ID NO:125; cDNA, 5'-PTEN-S-albumin-3', SEQ ID NO:153).

In another embodiment, the following N'-PTEN-S-albumin-PTEN-S-C' fusion was created: PR911 (SEQ ID NO:37; cDNA, 5'-PTEN-S-albumin-PTEN-S-3', SEQ ID NO:77).

In another embodiment, the following N'-PTEN-L-albumin-C' fusions were created: PR405 (SEQ ID NO:129; cDNA, 5'-PTEN-L-albumin-3', SEQ ID NO:157), PR406 (SEQ ID NO:130; cDNA, 5'-PTEN-L-albumin-3', SEQ ID NO:158), PR407 (SEQ ID NO:131; cDNA, 5'-PTEN-L-albumin-3', SEQ ID NO:159) and PR408 (SEQ ID NO:132; cDNA, 5'-PTEN-L-albumin-3', SEQ ID NO:160).

In another embodiment, the following N'-albumin-LUD-p53-C' fusion was created: F131 (SEQ ID NO:38; cDNA, 5'-albumin-LUD-p53-3', SEQ ID NO:78).

In another embodiment, the following N'-LUD-p53-albumin-C' fusion was created: F137 (SEQ ID NO:133; cDNA, 5'-LUD-p53-albumin-3', SEQ ID NO:161).

All cDNAs of mammalian PTEN-albumin fusions were sequence-optimized (e.g. SEQ ID 54-78; 135-161; 172-179; see FIG. 6 and Table 1), chemically synthesized, sequenced to confirm identity and subcloned as unique EcoRI-HindIII fragments between the EcoRI-HindIII sites of pTT5 (SEQ ID NO:173; FIG. 6C; Durocher & Loignon, 2009: patents-.google.com/patent/US8637315). All these operations were performed by GenScript, Inc. Piscataway, N.J.

In one example, the HSV-1 strain 17 [152,222 bp; NCBI Reference Sequence: NC 001806.2; National (UK) Collection of Pathogenic Viruses, catalog #0104151v] is used to create a recombinant oncolytic HSV-1 deprived of both ICP47 and ICP34.5 virulent HSV genes and carrying the albumin-PTEN fusion cDNAs disclosed herein (for example, SEQ ID NO:54-70, 74-77, 135-160,see also FIGS. 6D-6E). Initially, the virulent ICP47 gene encoding an MHCI-CD8(+) inhibitor is removed by two consecutive homologous recombination events. To that end, the upstream (up) and downstream (dn) flanking regions of the HSV-1 genome are PCR-amplified using the primer pairs 47upF (SEQ ID NO:212) & 47upR (SEQ ID NO:213) and 47dnF (SEQ ID NO:214) & 47dnR (SEQ ID NO:215), wherein the PCR products are subsequently digested with EcoRI/SpeI and HindIII-SalI, respectively. Complementary linkers (for example, SEQ ID NO:216-217) are then used to stitch the two flanking regions together between the EcoRI and SalI sites of the large pBSSK vector fragment, leading to the creation of plasmid pΔ47. The small EcoRI-XhoI fragment of pcDNA3.1-eGFP (Nova Lifetech, Hong Kong, catalog # PVT10754) containing the 239aa ORF of Green Fluorescent Protein (GFP) and the CMV5 promoter is then blunt end-ligated into the EcoRV site of p447 to create pΔ47-eGFP. The HSV-1/17+strain viral DNA and pA47-eGFP are then co-transfected into BHK cells to allow for the first HSV recombination, whereby ICP47 is replaced with eGFP to generate the HSV-1/17/Δ47-eGFP virus (FIGS. 6D-6E). The latter is plaque-purified 4 times, wherein 4-6 single plaques are picked and confirmed for eGFP expression under the fluorescent microscope each time. HSV-1/17/Δ47-eGFP is then recombined for a second time as above but now using the 0,47 plasmid instead, which leads to the elimination of eGFP from the second round progeny virus, rendering it devoid of ICP47 (HSV-1/17/Δ47 virus; FIGS. 6D-6E). To delete the second virulent gene, ICP34.5, which is the main determinant of HSV neuropathogenicity, the corresponding upstream (up) and downstream (dn) flanking regions of the HSV-1 genome are PCR-amplified using primer pairs 345upF (SEQ ID NO:218) and 345upR (SEQ ID NO:219) and 345dnF (SEQ ID NO:220) & 345dnR (SEQ ID NO:221), respectively, wherein the PCR products are then joined with overlapping PCR using the primer pair 345upF and 345dnR (SEQ ID NO:218, 221) and subsequently inserted into the large, blunt end-converted BamHI-XhoI pSP72 (Promega) vector fragment to create plasmid Δ34.5. The small EcoRI-XhoI fragment of pcDNA3.1-eGFP is then inserted into 034.5 to create pA34.5-eGFP. Similarly, the small SpeI-HindIII fragment of an albumin-PTEN fusion [containing the pTT5 CMV5 promoter region and each albumin-PTEN cDNA that is cloned between EcoRI-HindIII sites of pTT5) (see FIG. 6C)] is inserted into Δ34.5 to create pΔ34.5-PRn, wherein n corresponds a PR protein selected from SEQ ID NO:14-30, 34-37, 49-50 and 109-132, as disclosed herein (whereby for example, pΔ34.5-PR402 contains the cDNA of SEQ ID NO:68 and expresses the PR402 protein with SEQ ID NO:28, pΔ34.5-PR61 contains the cDNA of SEQ ID NO:59 and expresses the PR61 protein with SEQ ID NO:19, and so on). The HSV-1/17/Δ47 virus from the previous step is then subjected to two sequential recombination rounds. First, HSV-1/17/Δ47 viral DNA is recombined with pΔ34.5-eGFP to knock-in eGFP into the ICP34.5 locus, thereby creating HSV-1/17/Δ47/Δ34.5-eGFP virus (FIGS. 6D-6E). Following plaque-purification (4 times, wherein 4-6 single plaques are picked and confirmed for eGFP expression under the fluorescent microscope), as above, the HSV-1/17/Δ47/Δ34.5-eGFP virus is recombined with pΔ34.5-PRn to create the final recombinant oncolytic virus, HSV-1/17/Δ47/Δ34.5-PRn (FIGS. 6D-6E). The latter virus is assessed for transgene expression following infection in 4T1, MDAMB468, PC3 and other cells, and identification of the encoded protein using WB or activity-based assays, as it is known in the art and/or described herein. In one embodiment, the albumin-PTEN transgene of the recombinant HSV-1 Δ47/Δ34.5 albumin-PTEN virus is a polynucleotide selected from SEQ ID NO: 14-30, 34-37, 49-50 and 109-132. In another embodiment, the recombinant oncolytic HSV is constructed using CRISPR or TALEN methodology. In one embodiment, the virus is HSV-1. In another embodiment the HSV virus is HSV-2, which can be manipulated exactly as shown above (Zhao et al, 2014; PMID: 24671154). In another embodiment, the PTEN albumin fusion cDNA to be expressed by the recombinant oncolytic HSV virus has an N-terminal signal peptide cDNA selected of [nt (1-63) of SEQ ID NO: 171 or SEQ ID NO: 180-192]. In another embodiment the PTEN albumin fusion to be expressed has no signal peptide but an ATG codon for an initiator methionine residue is placed upstream of either mature albumin cDNA (selected from SEQ ID NO:176-179) or mature PTEN-L cDNA [selected from SEQ ID NO:167 or nucleotide (nt) 64-nt 1728 of SEQ ID NO:171], respectively, as appropriate. In another embodiment, the PTEN albumin fusion to be expressed has no signal peptide but an ATG codon for an initiator methionine replaces the first residue of mature albumin cDNA (selected from SEQ ID NO:176-179) or of mature PTEN-L cDNA [selected from SEQ ID NO:167 or nucleotide (nt) 64-nt 1728 of SEQ ID NO:171], as appropriate. In another embodiment, the recombinant oncolytic HSV virus carries/comprises one albumin-PTEN fusion cDNA selected of SEQ ID NO:54-70, 74-77, 135-160. In another embodiment the virus carries/comprises two or more albumin fusion cDNAs selected of SEQ ID NO:54-70, 74-77, 78, 135-160, 161. In a further embodiment, the recombinant oncolytic HSV virus carries/comprises one albumin-PTEN fusion cDNA selected of SEQ ID NO:54-70, 74-77, 135-160 and one PTEN cDNA selected of SEQ ID NO:71-73, 171-172, 166-167, 198-200, 204-206. In other embodiments, the recombinant virus carries/comprises one albumin-PTEN fusion cDNA and the cDNA of a heterologous protein, such as a monoclonal antibody, including a checkpoint antibody.

Example 1. Generation of Industrially Relevant PTEN-L & PTEN-S Human Serum Albumin Fusions Materials & Methods pTT5-based albumin PTEN fusion expression vectors were transiently transfected in HEK293, HEK293-6E or industrial grade Chinese Hamster Ovary (CHO-3E7) cells (Durocher & Loignon, 2009:patents.google.com/patent/US8637315). Both cell lines secrete the fusion proteins in the conditioned medium. Cells were grown in suspension in serum- and protein-free F17 synthetic medium (3 ml total volume) at 32° C. for up to 6 days post-transfection (dpt). The supernatant was sampled and cell viability assessed with Accumax every 24 h or as indicated. CHO-3E7 viability systematically exceeded 75% for all transient transfections under these conditions, whereas HEK293 was variable and influenced by the vector to be expressed, yet always above 65% at 5 dpt. Cell- and cell debris-free conditioned medium was loaded on 8-12% gradient SDS-PAGE as such. Gel-bound proteins were transferred onto a nitrocellulose membrane, which was firstly stained with Ponceau and then blotted with one the following primary antibodies (FIG. 6B):
Anti-PTEN antibodies:
a. Clone F-1 (Santa Cruz Biotech; catalog #sc-393186). According to the manufacturer, the mouse mAb F-1 binds aa(3-29) of human PTEN-S(SEQ ID NO:2). Because this region is identical in all mammalian PTEN-Ss, F-1 is a pan-PTEN mAb that can interact with all mammalian PTEN-L and PTEN-S proteins.
b. Clone A2B1 (Santa Cruz Biotech; catalog #sc-7974); According to the manufacturer, A2B1 was raised against aa(388-400) of human PTEN-S and is recommended for detection of human, mouse and rat PTEN-S. It is noted however, that while simian and human PTEN-S are identical, the rodent PTEN-S has a T398S mutation (which is nevertheless a very conservative substitution). Thus, the A2B1 mouse mAb is likely a pan-PTEN Ab, being able to interact with both human, simian and most likely, mouse and rat PTEN-L and PTEN-S.
c. Clone 138G6 (Cell Signaling; catalog #9556). The manufacturer does not disclose the exact target epitope of this rabbit mAb. However, Mingo et al, 2019 (PMID: 30993208)

demonstrated 138G6 binds aa(388-394) of human PTEN-S. This region is conserved among mammalian PTENs. Hence, 138G6 is a pan-PTEN mAb.

d. Clone SP218 (AbCam; catalog #ab228466P). The manufacturer does not disclose the target epitope of this rabbit mAb. However, Mingo et al, 2019 (PMID: 30993208) demonstrated SP218 binds aa(394-402) of human PTEN-S. This region spans the rodent PTEN-S T398S mutation. Hence, SP218 is a pan-human & simian PTEN mAb, which most likely interacts with mouse and rat PTEN-L and PTEN-S as well.

e. Clone 17.A (ThermoFisher; catalog #MA5-12278). The manufacturer does not disclose the target epitope of this mouse mAb. However, Mingo et al, 2019 (PMID: 30993208) demonstrated 17.A binds aa(392-402) of human PTEN-S. This region spans the rodent PTEN-S T398S mutation. However, according to the manufacturer, 17.A reacts with both mouse and human PTEN-S, suggesting it is a pan-human & simian PTEN mAb, which most likely interacts with mouse and rat PTEN-L and PTEN-S as well.

f. Clone 3A4.1 (Sigma Aldrich; catalog #MABS1680). This is a mouse mAb raised against the human LUD (SEQ ID NO:5) fused to GST and expressed in bacteria. The manufacturer does not disclose the target epitope. However, they claim 3A4.1 binds human PTEN-L; this means 3A4.1 also binds simian PTEN-L (which only has 1 mutation within the LUD, G116). It is nevertheless unknown whether 3A4.1 it would bind rodent PTEN-L, whereas it would of course not bind any PTEN-S.

Anti-Albumin Antibodies g. Clone AL-01 (ThermoFisher; catalog #MA1-19174). While the manufacturer does not disclose the target epitope of this mAb, they claim it is specific for HSA. The Applicant found that AL-01 can interact with PR413 [containing aa(1-385) of HSA; SEQ ID NO:121; cDNA SEQ ID:149)] but not PR414 (containing aa(1-197) of HSA; SEQ ID NO:122; cDNA SEQ ID NO:150). This suggests that the binding site of AL-01 is within [aa(362-375)] or domain II of HSA, a region which is very divergent between HSA (SEQ ID NO:13) and MSA (SEQ ID NO:92). Hence, AL-01 is a dII-binding, HSA-specific mAb.

h. Clone F-10 (Santa Cruz Biotech; catalog #sc-271605). According to the manufacturer, F-10 binds with aa(39-164), that is domain I of HSA. The manufacturer recommends usage of F-10 to also detect MSA and RSA. However, alignment of the HSA (SEQ ID NO:13) with SSA (SEQ ID NO:90) indicates there are only 3 divergent residues between aa(39-164) of SSA and HSA. Thus, F-10 is most likely a pan-albumin mAb that binds domain I of all mammalian albumins.

Anti-6×His antibodies. Two such clones were used herein: one from the Canadian National Research Council (Montreal, Quebec; in-house clone) and one from GenScript, Inc. (Piscataway, N.J.; catalog number #A00186), with very similar results.

The working dilutions of the mAbs were 1:100-1:1000, depending on the application (WB, IP), as indicated. In some embodiments, the secondary Ab was HRP-conjugated (FIG. 6B). Appropriate secondary antibodies were used at a 1:1000 dilution.

Results

Figure 7A:
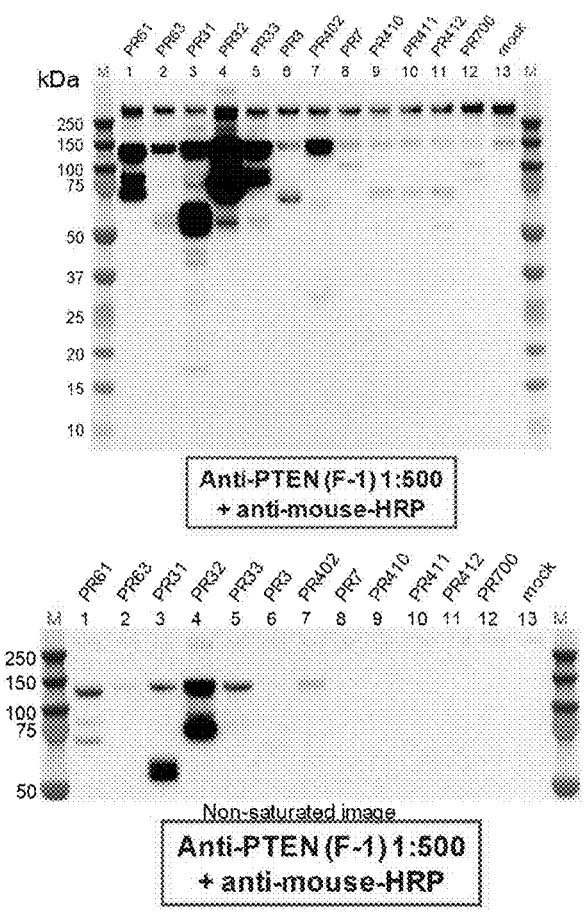
FIGS. 7A to 7B show expression and stability of various mutants secreted in the supernatants CHO-3E7 cells. Note the F-1 pan-PTEN antibody (Ab) (see FIG. 6B for its binding site) also binds a 300 KDa protein in the supernatants non-specifically (lane 13).
Figure 7B:
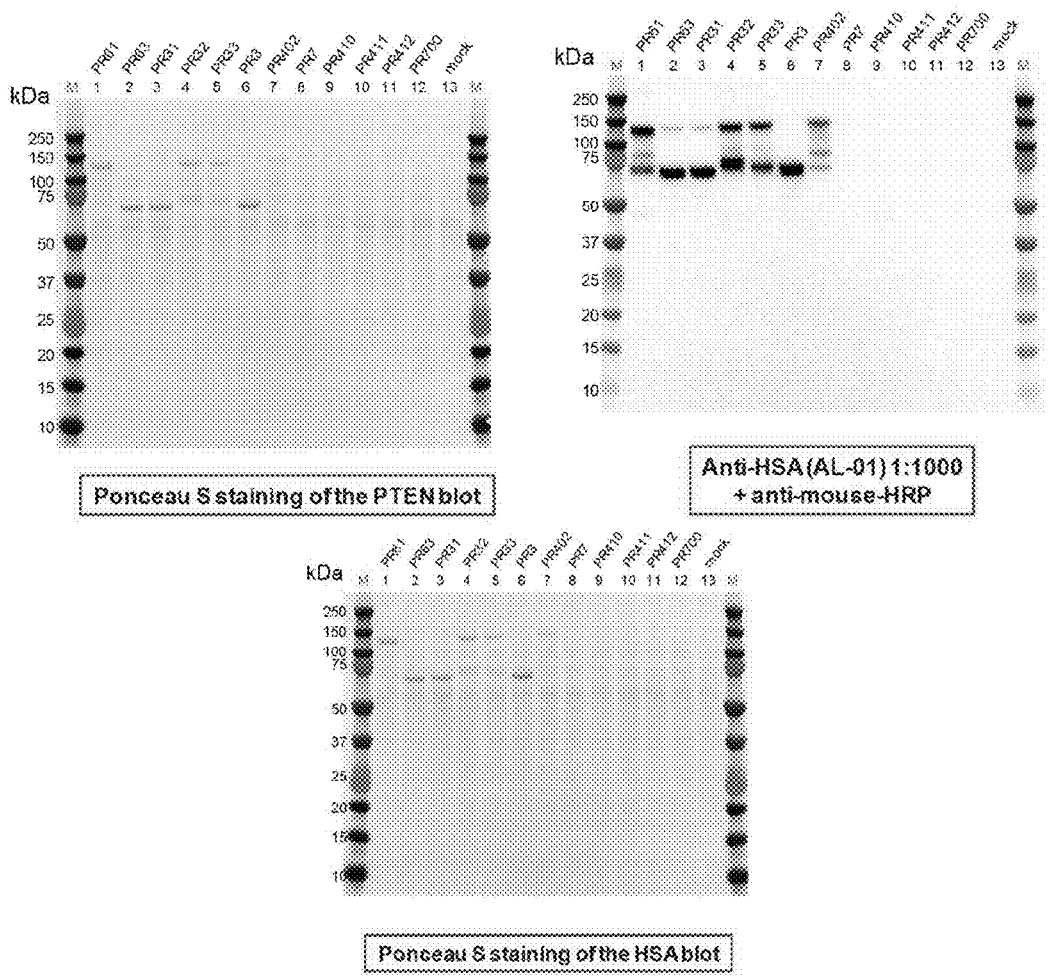

In line with previous reports that PTEN-L is secreted in minute amounts in the culture supernatant, from which it can be detected only after concentration (Hopkins et al, 2013: PMID: 23744781), C-terminally 6×His-tagged human PTEN-L [PR410 (SEQ ID NO:31; cDNA SEQ ID NO:71) ("6×His" disclosed as SEQ ID NO: 222) or PR411 (SEQ ID NO:32; cDNA SEQ ID NO:72)] was essentially not expressed/(-able) in industrial grade CHO-3E7 cells. Indeed, the protein was only barely, if at all, detectable by WB of the uncondensed culture medium, regardless of whether an albumin or an immunoglobulin leader drove secretion (FIG. 7; PTEN blots; observe PTEN-L at around 75 KDa in lanes 9-10 but not 13 of the overexposed WB). Mutation of the PTEN-M, N and O translational initiator residues, which, according to a report (Tzani et el, 2016: PMID: 27249819) may shift ribosome binding to the upstream leucine initiator of PTEN-L, thereby potentially increasing PTEN-L expression (PR412, SEQ ID NO:33; cDNA SEQ ID NO:73) did not help either (FIG. 7, lane 11 of the PTEN WBs). Under these conditions, the concentration of PR410, PR411 and PR412 in the CHO-3E7 culture supernatant was estimated to be well below 1 ng/ml. In contrast, cells secreted high amounts of other PTEN fusions such as PR61 (SEQ ID NO:19; cDNA SEQ ID NO:59) and PR32 (SEQ ID NO:24; cDNA SEQ ID NO:64) (see later), thereby demonstrating they were fit for purpose. Thus, wild-type (unfused) human PTEN-L cannot be meaningfully manufactured industrially by CHO cells.

Figure 8A:
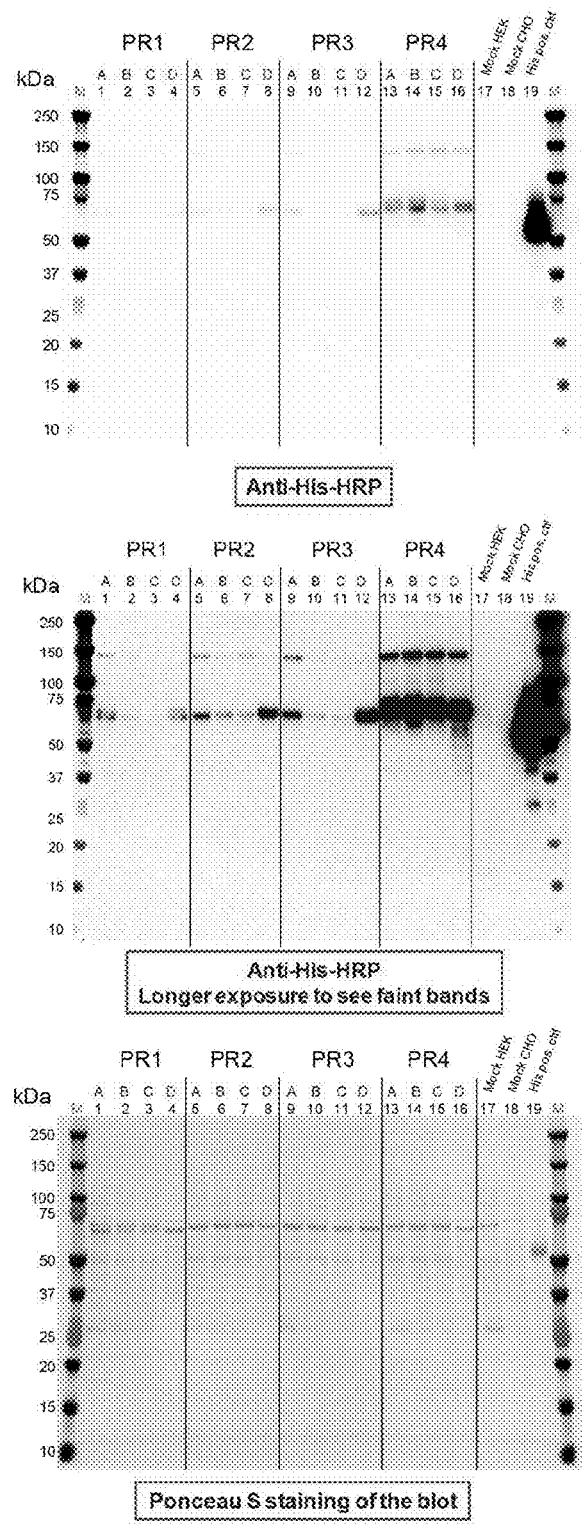
FIGS. 8A to 8B provide comparison of HEK293 grown under three different conditions and CHO-3E7 cells with respect to expression and stability of secreted PR1-4 (FIG. 8A) and PR5-8 (FIG. 8B).
Figure 8B:
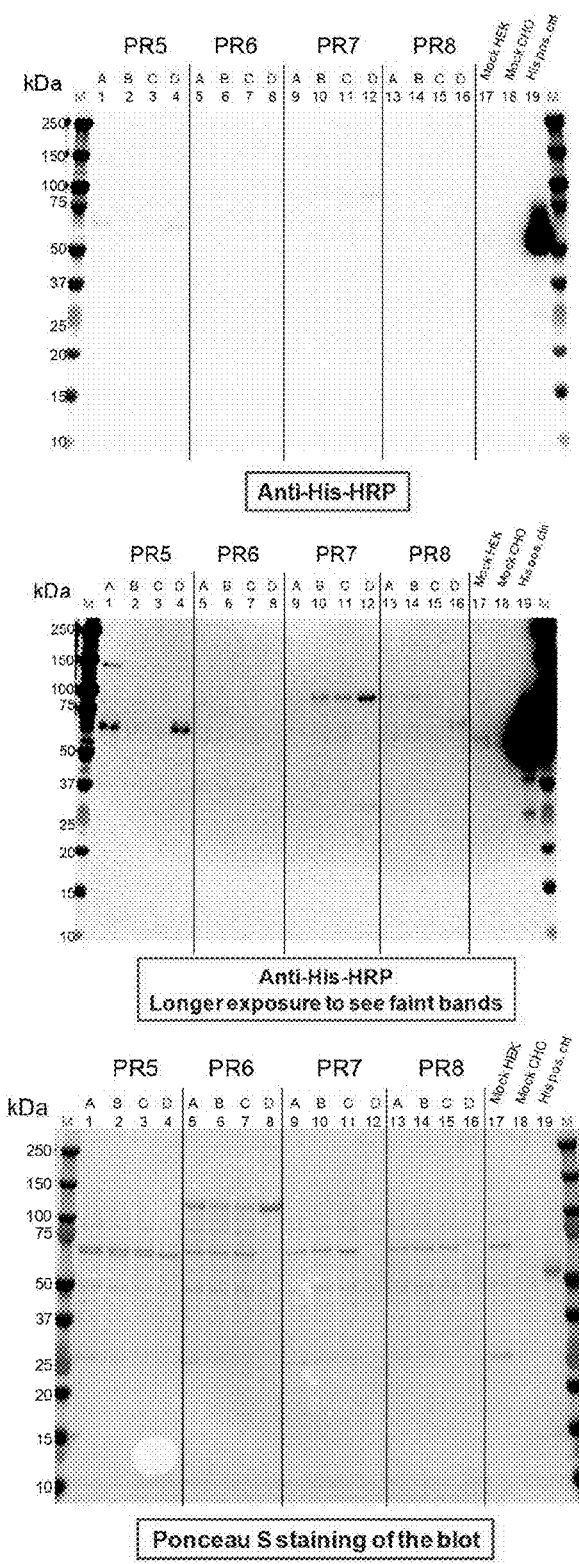

Addition of the immunoglobulin Fc tail sequence is a useful way to stabilize biologics. However, inclusion of Fc at its "natural" C-term position resulted in a PTEN-L fusion protein (PR7; SEQ ID NO:34; cDNA SEQ ID NO:74) that is indeed reproducibly detectable (FIG. 8B, overexposed WB, lanes 10-12 vs. 17-18; 80 KDa and FIG. 7; lane 8 vs. 13), yet not at all manufacturable (FIG. 8B, Ponceau, lanes 10-12; note that the 72 KDa and 77 KDa bands seen in lanes 9-11 are actually non-specific because the same exist in the mock-treated HEK293 supernatants; lane 17). Similarly, an ADCC-deficient PR7 variant bearing the N297Q mutation (PR700; SEQ ID NO:35; cDNA SEQ ID NO:75) is not expressed better than PR7 (FIG. 7, lanes 8, 12 and 13). In addition, PR7 (SEQ ID NO:34; cDNA SEQ ID NO:74) shows no improved expression over wild-type like PTEN-L (PR410-12; SEQ ID NO:31-33) (FIG. 7, lanes 8-13), suggesting that addition of the Fc tail at the 3'prime of PTEN-L is futile. Likewise, introduction of the Fc in the inverse orientation (PR8; SEQ ID NO:36; cDNA SEQ ID NO:76) reduces expression even further to almost undetectable levels (FIG. 8B; lanes 9-18). Again, cells secreted high amounts of PR6 (SEQ ID NO:18; cDNA SEQ ID NO:58) (FIG. 8B, Ponceau staining, lane 8), thereby demonstrating they were fit for purpose. Thus, addition of Fc in either orientation does not stabilize PTEN-L at all and cannot provide for industrially relevant manufacturing of the tumor suppressor.

Figure 9:
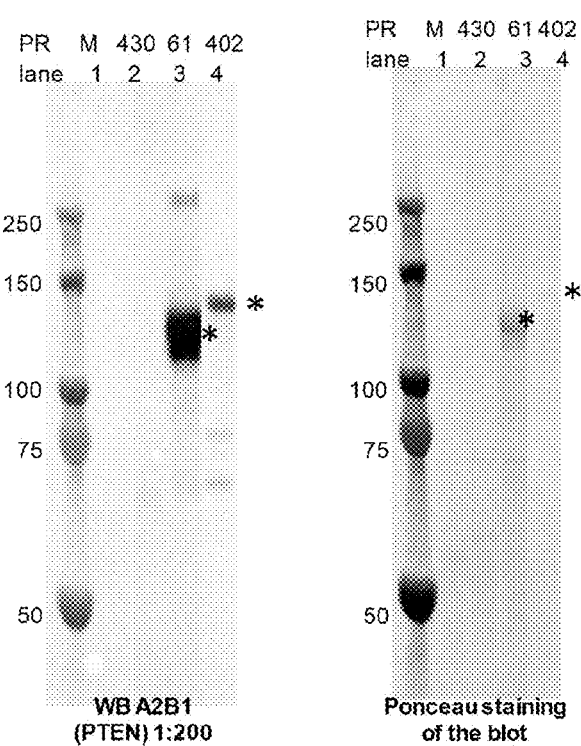
FIG. 9 shows that fusion of PTEN-L at the C' of thioredoxin does not lead to any appreciable secretion of the resulting (PR430) fusion by CHO-3E7 via the non-canonical (leaderless) pathway known to mediate Trx1 secretion in other mammalian cells. Stars denote the successful secretion of PR402 and PR61 under the same conditions.

Because Rubartelli & Sitia R, 1991 (PMID: 1889608) had shown that IL-1 and thioredoxin (Trx-1) may be secreted by normal cells via a non-canonical pathway (i.e. without any signal peptide leader); Trx-1 is known to interact with PTEN-S (Meuillet et al, 2004; PMID: 15313215); and Trx-1 fusion upstream of the PTEN-L coding sequence may partially stabilize the protein in insect cells (FIG. 5), the Applicant constructed the PR430 fusion (SEQ ID NO:49; cDNA SEQ ID NO:135). However, unlike PR61 (SEQ ID NO:19; cDNA SEQ ID NO:59) and PR402 (SEQ ID NO:28; cDNA SEQ ID NO:68)(see below), PR430 (SEQ ID NO:49; cDNA SEQ ID NO:135) cannot be secreted in CHO supernatants either (FIG. 9). Under these conditions, PR61 was expressed at much higher levels than PR402 (see also FIG. 7).

The Applicant then constructed a series of albumin PTEN fusions by joining pre-protein HSA (SEQ ID NO:12) upstream of PTEN-M to create PR1 (SEQ ID NO:14; cDNA SEQ ID NO:54), PR2 (SEQ ID NO:15; cDNA SEQ ID NO:55), PR3 (SEQ ID NO:16; cDNA SEQ ID NO:56) and PR5 (SEQ ID NO:17; cDNA SEQ ID NO:57), or upstream of PTEN-S to create PR6; (SEQ ID NO:18; cDNA SEQ ID NO:58), respectively. Applicant also constructed the inverse mutant PR4 (SEQ ID NO:26; cDNA SEQ ID NO:66), in which PTEN-L precedes the processed, secreted form of HSA (SEQ ID NO:13). PR1-4 were first expressed in HEK293 and CHO-3E7 cells and proteins assayed in culture supernatants by WB using an anti-His antibody (FIG. 8A). Industrial grade CHO-3E7 cells secreted more total exogenous PR proteins than HEK293 cells in almost all cases studied, except for PR4 (SEQ ID NO:26; cDNA SEQ ID NO:66) the expression of which was essentially identical between HEK293 and CHO-3E7 (FIG. 8A; lanes A-C vs D). All N-terminal HSA fusions (PR1-3) migrated at the expected MW of 120-130 KDa (FIG. 7, His blot, longer exposure), yet underwent extensive degradation into 1 or 2 major bands of 60-70 KDa (FIG. 8A, Ponceau); one of these 60-70 KDa degradants is HSA, because it is picked up by the C-terminal His epitope tag antibody (FIG. 8A, His blot). PR5, which is similar to PR1-3, also undergoes extensive degradation in both HEK293 and CHO-3E7 cells (FIG. 8B). In contrast, and much to the Applicant's surprise, PR4, which initiates with PTEN-L and ends with mature HSA at the C' prime (SEQ ID NO:26; cDNA SEQ ID NO:66) is more stable than PR1-3 and PR5, though still also being degraded to a considerable extent (FIG. 8A). Even more paradoxically, PR6 (SEQ ID NO:18; cDNA SEQ ID NO:58), whose domain structure resembles PR1-3 & PR5 was degraded only marginally, if at all, and was expressed in very high amounts (FIG. 8B, Ponceau; lanes 5-8 vs. 17-18; note that PR6 is HA-tagged and hence does not crossreact with the anti-His mAb WB in FIG. 8B lane 8).

These results suggested that PR4 (SEQ ID NO:26; cDNA SEQ ID NO:66) and especially PR6 (SEQ ID NO:18; cDNA SEQ ID NO:58) could be manufacturable to industrially relevant levels. Applicant hence created variants of both PR4 and PR6. First of all, the acidic HA epitope tag found at the C-term of PR6 (SEQ ID NO:18; cDNA SEQ ID NO:58) was replaced with a 6×His tag (SEQ ID NO: 222) to create PR61 protein fusion (SEQ ID NO:19; cDNA SEQ ID NO:59). Moreover, it was hypothesized that the partial proteolysis of PR4 might be due to the existence of a MMP2/9 & furin-sensitive linker (SEQ ID NO:48) on the PR4 protein. Along this idea, proteases released upon cell death during culture would attack PR4 on its linker SEQ ID NO:48; such proteolysis is a well known problem in the art. Accordingly, the HA tag and SEQ ID NO:48 were removed from PR4, whereas the 6×His tag (SEQ ID NO: 222) was placed at the end, resulting in the creation of PR402 (SEQ ID NO:28; cDNA SEQ ID NO:68).

Sequence-optimized cDNAs corresponding to PR61 and PR402 (SEQ ID NO:59 and 68, respectively) were cloned into pTT5 (cDNA SEQ ID NO:173; FIG. 6C) and the recombinant vectors transiently transfected in CHO-3E7 cells. The results demonstrated that while there was still some degradation of PR402 (FIG. 7; anti-PTEN & HSA blots; lane 7), a substantial portion of PR402 (SEQ ID NO:28; cDNA SEQ ID NO:68) could now be secreted in the culture supernatant at the expected MW of about 130 KDa, in what apparently constitutes moderate, yet overall industrially relevant full-length PR402 levels (FIG. 7; esp. Ponceau stainings; lane 7 vs. 13). Similarly, and as expected from Applicant's results with PR6, PR61 (SEQ ID NO:19; cDNA SEQ ID NO:59) contributed an excellent absolute level of expression, having now become detectable also with anti-6×His (FIG. 7; WB and esp. Ponceau stainings; lane 1 vs. 13). In both cases, the absolute levels of both PR402 (SEQ ID NO:28; cDNA SEQ ID NO:68) and PR61 (SEQ ID NO:19; cDNA SEQ ID NO:59) were much higher than those contributed by all unfused PTEN-L variants and both PTEN-L/Fc fusions (FIG. 7; esp. Ponceau stainings; lane 1, 7 vs. 8-13), wherein PR61 was once again expressed at much higher levels than PR402 (see also FIG. 9).

Another conclusion that was drawn from FIG. 8A is that inclusion of the PTEN-M-Unique Domain (MUD; SEQ ID NO:9) at the N' of PR6 collapses the quite stable PR6 protein onto a rather unstable PR3 (SEQ ID NO:16; cDNA SEQ ID NO:56) fusion. Such a profile is consistent with intracellular or cell-debris-derived proteolytic activity targeting the MUD and by extension the LUD (SEQ ID NO:5). If so, then progressive addition of LUD sequences onto PR6 or PR61 should render the latter sensitive to proteases. Indeed, integration of SEQ ID NO:51 linker, [which corresponds to aa(43-79) of the LUD and is defined as the wider cell-penetration domain (WCPD)], in frame between the HSA and PTEN-S moieties of PR61 was sufficient to render the resulting fusion, PR31 (SEQ ID NO:23; cDNA SEQ ID NO:63), sensitive to degradation (FIG. 7; especially Ponceau stainings; lanes 1, 3 and 13). Because Leu43 of PTEN-L (SEQ ID NO:1) is also the initiator amino acid of PTEN-N(SEQ ID NO:7), just upstream of the Arg-rich MCPD, it can be anticipated that like PR31, an HSA-PTEN-N fusion is susceptible to proteolysis as well. Similarly, addition of CPD*sequence [SEQ ID NO:53, which is a short version of WCPD and corresponds to aa(44-59) of the LUD], is sufficient to render the resulting fusion, PR63 (SEQ ID NO:21; cDNA SEQ ID NO:61), sensitive to degradation as well (FIG. 7; especially Ponceau stainings; lanes 1-2 vs. 13). Thus, fusion of WCPD (SEQ ID NO:51) linker as a whole or of deletion mutants thereof, such as the CPD* (SEQ ID NO:53) or most likely just the minimal 6Arg portion (aka the MCPD; SEQ ID NO:39), between the HSA and PTEN-S moieties of PR6 or PR61, renders the resulting fusions sensitive to an MCPD-targeting protease, such as furin, which targets Arg-rich sequences (Tian et al, 2016; PMID: 21541042). Hence, WCPD-containing fusions, such as PR31 (SEQ ID NO:23; cDNA SEQ ID NO:63) and PR63 (SEQ ID NO:21; cDNA SEQ ID NO:61) are essentially non-manufacturable. In contrast, when the linker to be fused in frame between the two PR61 moieties contains consecutive amino acids of SEQ ID NO:52, the resulting fusions, such as PR32 (SEQ ID NO:24; cDNA SEQ ID NO:64) and PR33 (SEQ ID NO:25; cDNA SEQ ID NO:65) are protected from cleavage and hence are fully manufacturable (FIG. 7; especially Ponceau stainings; lanes 1 vs. 4-5 and 13).

Figure 10B:
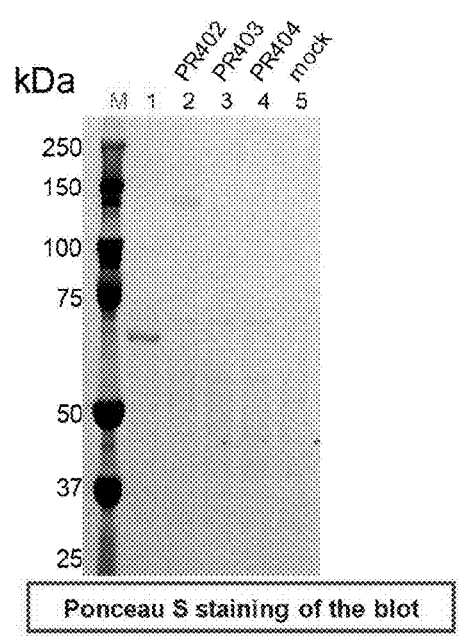

That the Arg-rich, CPD* sequence (SEQ ID NO:53; cDNA SEQ ID NO:170) confers sensitivity to a furin-like protease was also confirmed by engineering PR402 variants containing the CPD*, namely PR401 (SEQ ID NO:27; cDNA SEQ ID NO:67), PR403 (SEQ ID NO:29; cDNA SEQ ID NO:69) and PR404 (SEQ ID NO:30; cDNA SEQ ID NO:70). Indeed, as opposed to PR402 (SEQ ID NO:28; cDNA SEQ ID NO:68), which is predominantly protected from furin-like degradation, PR401, PR403 and PR404 were degraded completely in the CHO-3E7 supernatants (FIG. 10).

Because of this unexpected resistance of PR402 (SEQ ID NO:28; cDNA SEQ ID NO:68) to furin-like degradation, the Applicant wondered whether inhibition of this protease might render the PR3 mutant (SEQ ID NO:16; cDNA SEQ ID NO:56) manufacturable as well. To that end, both non-specific and specific protease inhibitors were tested. FIG.

Figure 11A:
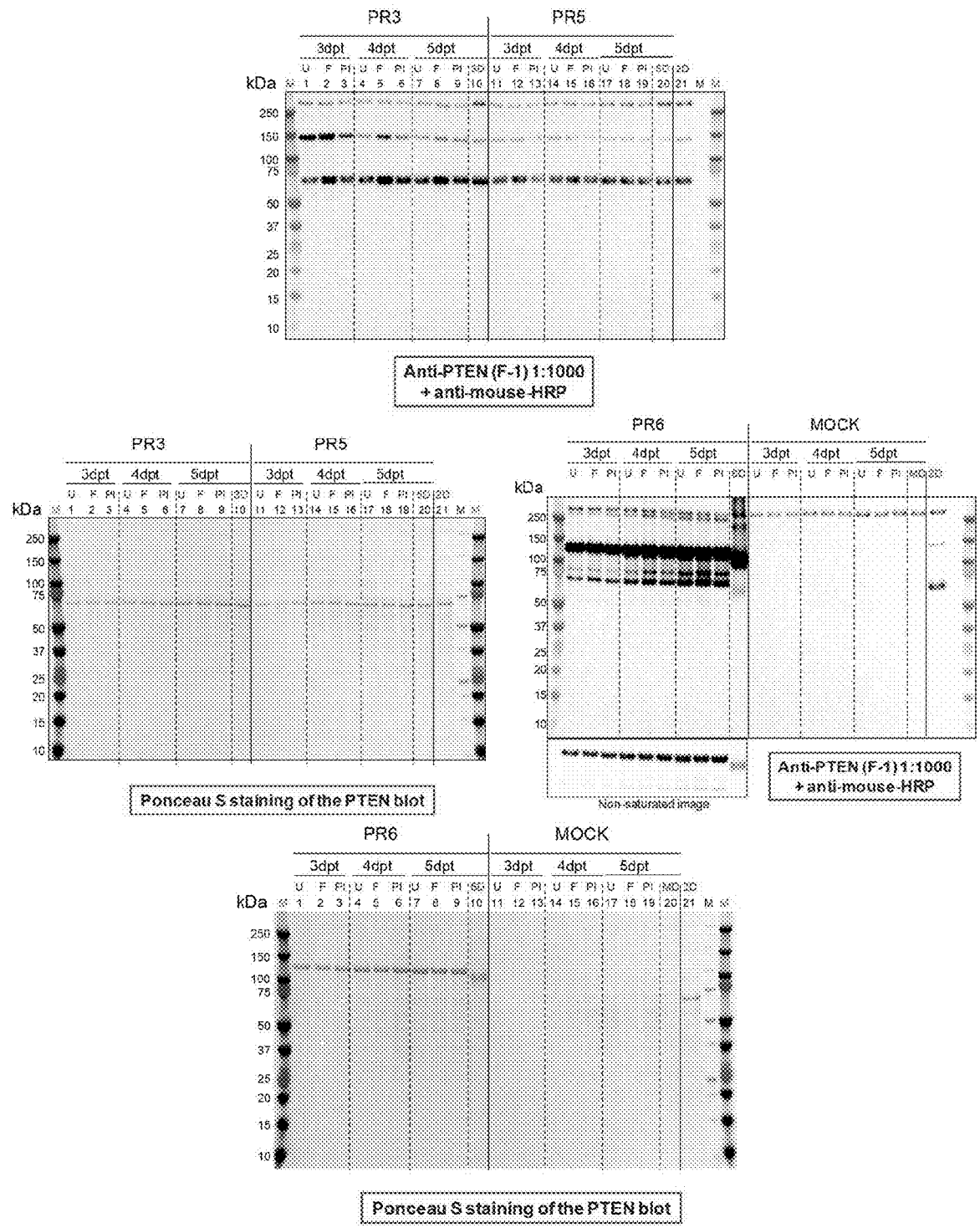
Figure 11B:
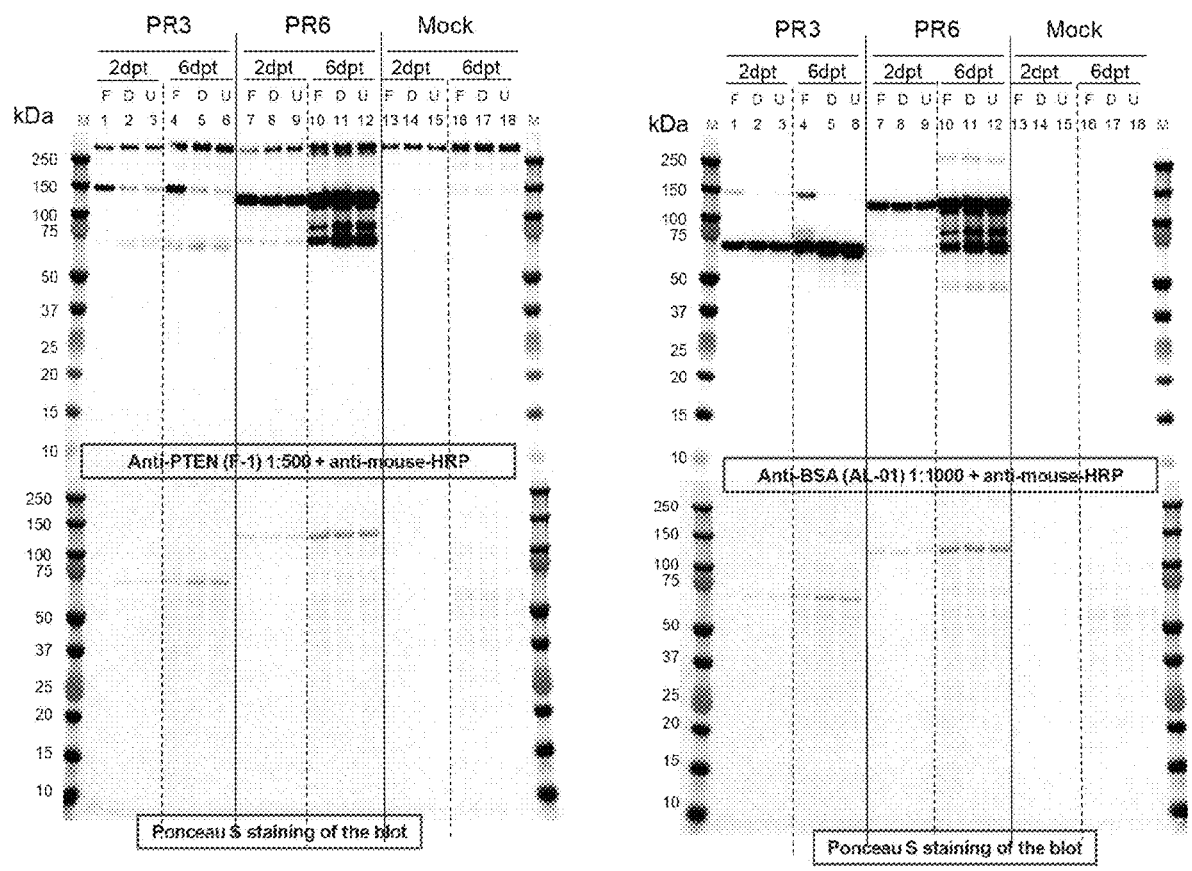
Figure 11D:
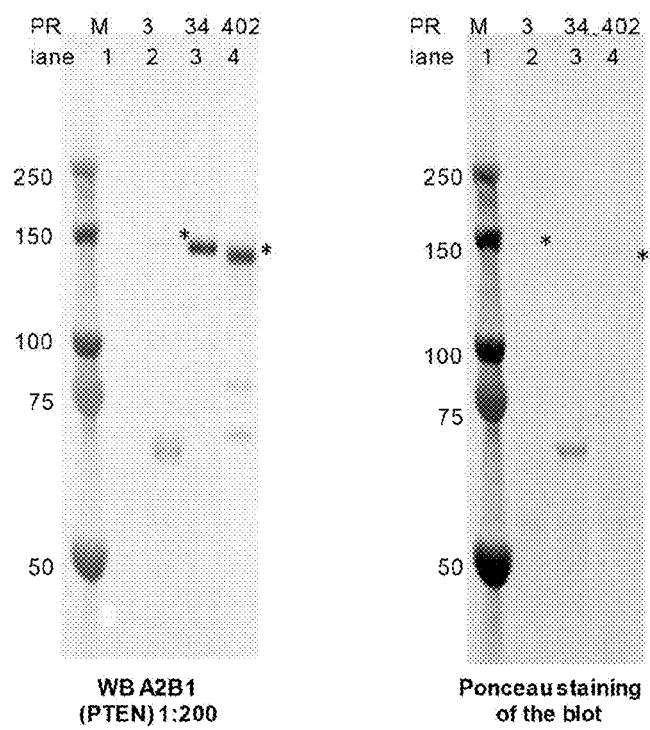

11A shows that non-specific protease inhibitors like ferric citrate or protease inhibitor tablets have a marginal protective effect on PR3 (SEQ ID NO:16; cDNA SEQ ID NO:56) and PR5 (SEQ ID NO:17; cDNA SEQ ID NO:57) initially (WB anti-PTEN; 3-4 dpt), which then, as the culture continues, is unfortunately progressively lost (Ponceau staining; 4-5 dpt). In contrast, PR6 (SEQ ID NO:18; cDNA SEQ ID NO:58) is insensitive to both protease inhibitor treatments and hence its expression increases over time (FIG. 11A, WB anti-PTEN; non-saturated image and FIG. 11A; lanes 1-18). Treatment of the cultures with a cell-permeable furin catalytic center peptide inhibitor (Calbiochem/Merck Millipore #344930) indeed increased the amount of full length PR3 (SEQ ID NO:16; cDNA SEQ ID NO:56) produced by cells both at 2 dpt and 6 dpt (FIG. 11B; lanes 1-6 vs. 13-18), though a reduction of cell viability was noted (FIG. 11B, legend). In contrast, and as expected again by Applicant's results, expression of PR6 (SEQ ID NO:18; cDNA SEQ ID NO:58) was insensitive to the furin inhibitor and increased over time (FIG. 11B; lanes 7-18). Consistent with furin mediating the cleavage of the albumin-PTEN-L fusions, when full length PR1 protein (SEQ ID NO:14; cDNA SEQ ID NO:54) made in large amounts was excised from the gel and sequenced by LC/MS, a cleavage site between 2 arginine residues in the furin consensus sequence could be mapped (FIG. 11C). Finally, genetic deletion of the putative furin cleavage site, that is of the MCPD, from PR3, resulted in a mutant (PR34; SEQ ID NO:50; cDNA SEQ ID NO:136) that is protected from cleavage (FIG. 11D). These results demonstrate that furin or a furin-like protease cleaves the LUD (SEQ ID NO:5), most likely within the 6-Arg Minimal Cell Penetration Domain (SEQ ID NO:39).

The cell line provider Horizon Discovery sells a knockout HAP1 stable cell line, whereby CRISPR/Cas editing has been used to create a 2 bp deletion in a coding exon of Furin, leading to the loss of protein in these cells (Catalog ID: HZGHC001302c001). This indicates that generation of a mammalian furin knock out cell line is possible in the absolute sense. As such, based on the Applicants disclosure, it would be straightforward for a skilled person to generate a CHO-3E7 or HEK293 furin knock out derivative and demonstrate that secretion of PTEN-L fusions[including but not limited to PR3 (SEQ ID NO:16; cDNA SEQ ID NO:56), PR63 (SEQ ID NO:21; cDNA SEQ ID NO:61), PR31 (SEQ ID NO:23; cDNA SEQ ID NO:63), PR62 (SEQ ID NO:20; cDNA SEQ ID NO:60); (see FIG. 7, Ponceau stainings)] would be increased in the resulting furin knock out cell line.

Figure 12A:
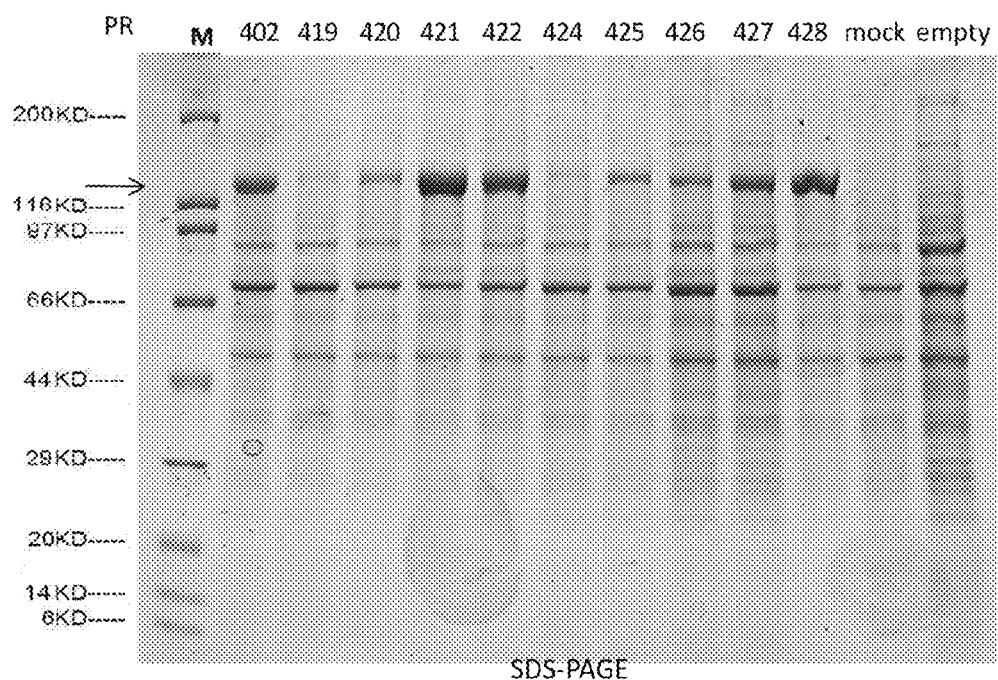
FIGS. 12A to 12D provide evaluation on secretion of various fusion proteins.

To assess the impact of various signal peptides on the expression levels of PR402, the HSA Signal Peptide (SEQ ID NO:93) of PR402 was replaced with the Signal Peptides of proteins known to be secreted in large amounts in human plasma (Table 1; SEQ ID NO:97-105). As such, PR419 (SEQ ID NO:109; cDNA SEQ ID NO:137), PR420 (SEQ ID NO:110; cDNA SEQ ID NO:138), PR421 (SEQ ID NO:111; cDNA SEQ ID NO:139), PR422 (SEQ ID NO:112; cDNA SEQ ID NO:140), PR424 (SEQ ID NO:113; cDNA SEQ ID NO:141), PR425 (SEQ ID NO:114; cDNA SEQ ID NO:142), PR426 (SEQ ID NO:115; cDNA SEQ ID NO:143), and PR427 (SEQ ID NO:116; cDNA SEQ ID NO:144), were created. The mouse equivalent of PR402 consisting of mouse PTEN-L, MSA driven by the MSA signal peptide was also constructed (PR428; SEQ ID NO:117; cDNA SEQ ID NO:145). The corresponding expression vectors were transiently transfected in HEK293 cells and foreign proteins in the culture supernatant were detected by SDS-PAGE (FIG. 12A). All Signal Peptides were found to direct detectable amounts of mature PR402. However, the native HSA (SEQ ID NO:93), the murine α1-antitrypsin (SEQ ID NO:99), the murine IgGκ chain (SEQ ID NO:100) and, expectedly, the MSA Signal Peptide (SEQ ID NO:96) appeared to best out all others in terms of total secreted protein as estimated by visual inspection of the gel (FIG. 12A).[As discussed below, the HSA Signal Peptide also drives correct expression and cleavage of the PR402 fusion (SEQ ID NO:28; cDNA SEQ ID NO:68) because the identity of the latter is 99.5% identical to the expected, cleaved PR402 sequence, as determined by LC/MS (FIG. 19A). Hence, the native HSA Signal Peptide is a preferred leader sequence for all PTEN proteins disclosed herein].

Figure 12B:
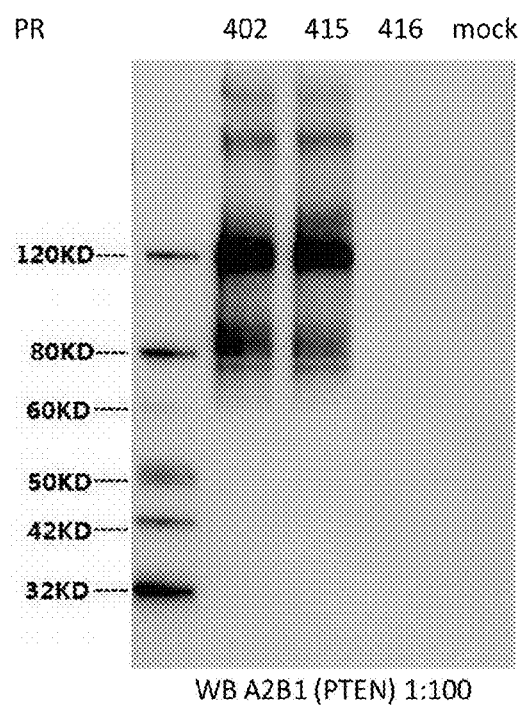
Figure 12C:
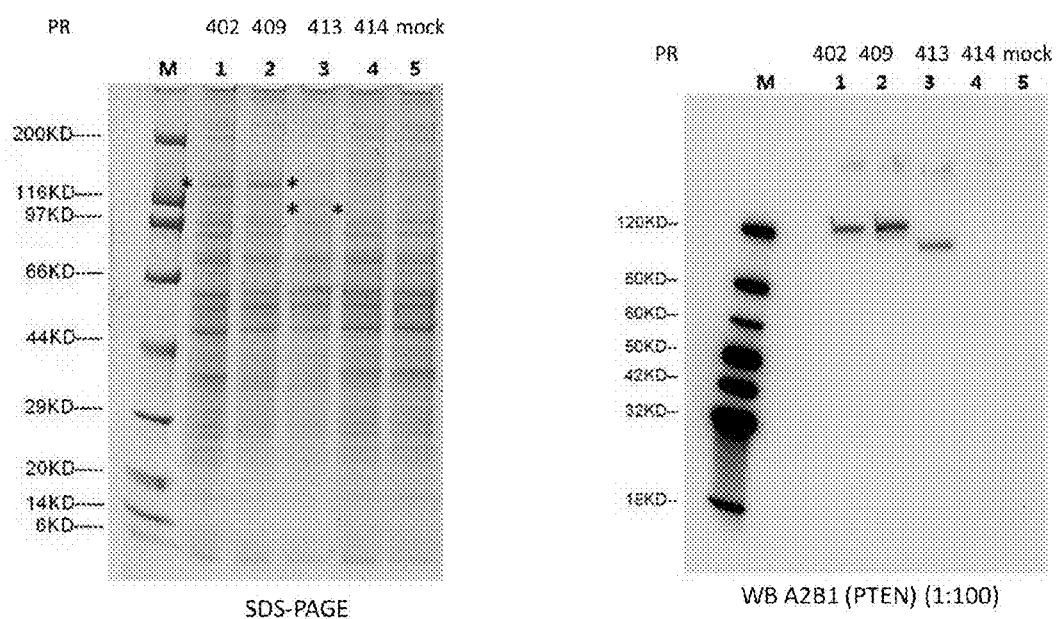

The Applicant had previously found soluble PTEN-M is expressed in higher amounts in bacteria (unpublished results). This is consistent with the results of Tzani et al, 2016: PMID: 27249819, who showed PTEN-M may be expressed in higher amounts than PTEN-L in mammalian cells. However, the very opposite was the case when PTEN-M was fused downstream of the HSA Signal Peptide. FIG. 12B shows that, unexpectedly, the PTEN-M-HSA fusion PR416 (SEQ ID NO:120; cDNA SEQ ID NO:148) fails to be secreted at all even though it only lacks 6 aminoacids at the N-terminus, whereas PR402 (SEQ ID NO:28; cDNA SEQ ID NO:68) and PR415 (SEQ ID NO:119; cDNA SEQ ID NO:147) are made in comparable amounts. (It is noted that both PR415 (SEQ ID NO:119; cDNA SEQ ID NO:147) and PR416 (SEQ ID NO:120; cDNA SEQ ID NO:148) harbor a mutated scavenger HSA Cys34Ser; however this has no appreciable impact on PR415 expression according to FIG. 12B). Thus, the HSA Signal Peptide (SEQ ID NO:93) requires the wild-type N-terminus of PTEN-L (consisting of the wild-type 6 aa sequence SESPVT (residues 1-6 of SEQ ID NO: 3); see SEQ ID NO:3) to allow for PR402 to be effectively secreted, and it does not mediate secretion from a PTEN-M terminus (PR416 background), which lacks this 6 aa stretch. Paradoxically once again, however, inclusion of an acidic epitope tag (HA tag) upstream of PTEN-L's initiating Ser, still allows for effective synergy with the native HSA signal peptide, leading to effective (and, if anything, somewhat increased) secretion of the resulting variant PR409 (SEQ ID NO:118; cDNA SEQ ID NO:146) (FIG. 12C; lanes 1-2). Still, the difference of expression between PR409 (SEQ ID NO:118; cDNA SEQ ID NO:146) and PR402 (SEQ ID NO:28; cDNA SEQ ID NO:68) is not dramatic, suggesting that the potential of further engineering the unique 6 aa stretch of the PTEN-L N-terminus to increase expression in the PR402 background should be balanced against the possibility this engineering would introduce immunogenic determinants on a naturally occurring protein like PTEN-L.

Figure 12D:
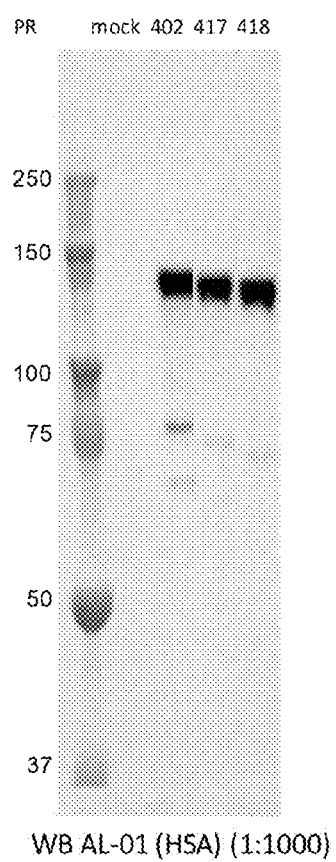

In another embodiment, the minimal albumin domain that could be placed at the C' of PTEN-L and still mediate efficient secretion of the resulting (PR402-like) fusion was determined. Deletion of the HSA's FcRn binding domain dIII at the HSA C' prime reduced the overall secretion of the resulting fusion, PR413 (SEQ ID NO:121; cDNA SEQ ID NO:149), to about 30-40% of control PR402 levels (FIG. 12C, lane 3 vs. 1 and 5), whereas further deletion of domains II and III resulted in an undetectable fusion (PR414; SEQ ID NO:122; cDNA SEQ ID NO:150) (FIG. 12C, lane 4 vs. 1, 3 and 5). In contrast, progressive deletion from the N' of HSA and up to aa 63 thereof had no effect, as the resulting fusions (PR417; SEQ ID NO:123; cDNA SEQ ID NO:151), which lacks the first 34aa of HSA and PR418 (SEQ ID NO:124; cDNA SEQ ID NO:152), which lacks the first 62 aa of has appeared indistinguishable vs. PR402 (FIG. 12D). Thus, aa(63-385) or more preferably aa(63-585) of HSA (SEQ ID NO:163) is the minimal albumin domain that is sufficient to stabilize PTEN-L in the N'-PTEN-L-albumin-C'(PR402-like) orientation.

Figure 13:
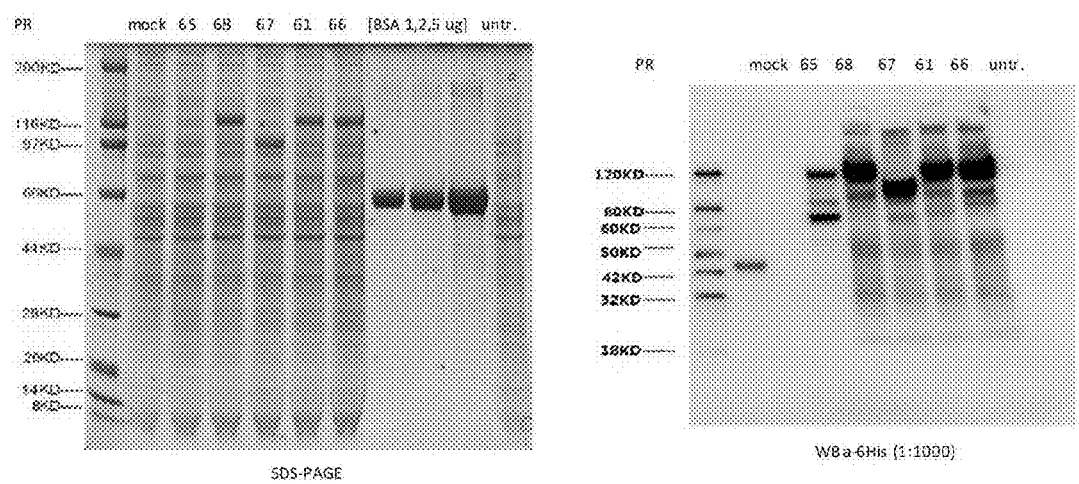
FIG. 13 shows that even though PR65 has a similar domain structure to PR402 (PTEN-S-HSA and PTEN-L-HSA), PR65 is surprisingly hardly detectably secreted in the CHO cell supernatants, unlike the inverse mutant PR61 and its mouse (PR68) & rat (PR66) homologues. Remarkably, domain III of RSA (PR67) is apparently redundant for PTEN-S stabilization, as opposed to PTEN-L stabilization (FIG. 12C). Varying amounts of BSA (purified recombinant Bovine Serum Albumin) were included in the gel so as to provide an estimate of the yield of PR61-like proteins in the CHO-3E7 cell supernatants.

In a follow up experiment, inversion of the relative orientation of the PTEN-S and albumin domains of PR61 resulted in a fusion protein (PR65, SEQ ID NO:125; cDNA SEQ ID NO:153) that was essentially not secretable by CHO-3E7 cells, as it could only be detected in trace amounts by overexposing the WB (FIG. 13), whereas a control fusion, wherein the MUD (SEQ ID NO:9) was sandwiched between two PTEN-S moieties and a glycine linker (PR911, SEQ ID NO:37; cDNA SEQ ID NO:77) was not expressed at all (results not shown). In contrast, PR61 (SEQ ID NO:19; cDNA SEQ ID NO:59) was once again secreted at very high levels in the CHO supernatants, as did analogous PR61 fusions whereby HSA had been replaced with either RSA (PR66; SEQ ID NO:126; cDNA SEQ ID NO:154), or with wild-type MSA (PR68; SEQ ID NO:128; cDNA SEQ ID NO:156) (FIG. 13). Remarkably, PR67 (SEQ ID NO:127; cDNA SEQ ID NO:155), an RSA domain III deletion mutant that presumably lacks binding to rat FcRn (Sand et al, 2015: PMID: 25674083) was expressed in comparable levels to PR61 (FIG. 13), as opposed to PR413 (SEQ ID NO:121; cDNA SEQ ID NO:149), which is only made to about 30% of PR402 levels (FIG. 12C). Thus, albumin dIII, or in general the minimal albumin domain (SEQ ID NO:163) is more important for the stabilization of PTEN-L-like (e.g. PR402; SEQ ID NO:28; cDNA SEQ ID NO:68) rather than PTEN-S-like (e.g. PR61; SEQ ID NO:19; cDNA SEQ ID NO:59) fusions. Still, it is to be noted here that the molecular mechanism whereby fusion to HSA leads to higher PTEN-L (e.g. PR402; SEQ ID NO:28; cDNA SEQ ID NO:68) and PTEN-S (e.g. PR61; SEQ ID NO:19; cDNA SEQ ID NO:59) expression and secretion is unknown. While potential intramolecular interaction of PTEN-L/PTEN-S with HSA is possible in either the PR402 or the PR61 orientation, previously HSA was shown to be unable to bind PTEN-S in co-localization, co-immunoprecipitation, and molecular docking experiments, even though α-fetoprotein, a structurally related, albumin-like oncoprotein, could interact with PTEN-S under the same conditions (Zhu et al, 2015; PMID: 26078940).

In summary, the wild-type PTEN-L tumor suppressor cannot be meaningfully expressed in any of the major known industrial expression systems (*E. coli, C. glutamicum*, yeast, CHO/293 cells). Furthermore, fusion of PTEN-L to thioredoxin does not lead to appreciable secretion either. Likewise, fusion of PTEN-L to the Fc antibody portion in either orientation is also futile. Similarly, fusion of PTEN-L at the C'-prime of HSA (e.g. in PR3) also results in extensive degradation of the resulting fusion protein, which defeats any manufacturing purpose. In contrast, and quite surprisingly, PR402 (SEQ ID NO:28; cDNA SEQ ID NO:68) consisting of PTEN-L followed by mature HSA leads to industrially acceptable levels of the protein, that could be potentially improved upon further optimization (for example at the level of signal peptide selection and primarily by prevention of degradation through down-regulation of furin protease or by using perfusion of the cell culture), whereas, unexpectedly, PR416 (SEQ ID NO:120; cDNA SEQ ID NO:148), a PR402 variant consisting of wild-type PTEN-M followed by mature HSA was not expressed at all. Furthermore, in stark contrast to PR402 (SEQ ID NO:28; cDNA SEQ ID NO:68) and its variants (PR4, PR401), the homologous construction PR65 (SEQ ID NO:125; cDNA SEQ ID NO:153), whereby PTEN-S is followed by albumin, is essentially not secreted by CHO-3E7 cells, which is the exact opposite of what one would have expected based on the Applicant's results with PR3 (SEQ ID NO:16; cDNA SEQ ID NO:56) and PR402 (SEQ ID NO:28; cDNA SEQ ID NO:68). In contrast, PR61 (SEQ ID NO:19; cDNA SEQ ID NO:59) and PR6 (SEQ ID NO:18; cDNA SEQ ID NO:58), both inverse versions of PR65, totally paradoxically and quite dramatically, are secreted in very large amounts and are substantially degradation-resistant. Thus, following extensive mutagenesis, the Applicant has demonstrated that albumin unexpectedly solubilizes both PTEN-L and PTEN-S but only if placed in the opposite orientation each time (FIG. 6A). Further biophysical & crystallographic studies would be required to help understand the molecular basis of this remarkable dichotomy of the PTEN-L/PTEN-S-HSA fusions. Nevertheless, The Applicant's results could not have been possibly predicted by any skilled person in the art.

Example 2. Generation of Cleavable PTEN-L& PTEN-S Human Serum Albumin Fusions

Hopkins et al, 2013 (PMID: 23744781) reported that while treating mice bearing subcutaneous human cancer xenografts with exogenous PTEN-L, PTEN-L was found not only in tumor cells of the cancer, but also in cells of the normal mouse tissues, such as lung and brain (as estimated by the reduction of pi3K pathway pharmacodynamic biomarker phosphorylation). This suggests that PTEN-L cannot discriminate between cancer and normal cells in vivo. However, cancer cell selectivity of the tumor suppressor is likely to be influenced by the state of the extracellular matrix (ECM), which is completely aberrant in cancer tissue. This is because cancer cells secrete a variety of intracellular proteases in the extracellular space so as to promote their aberrant growth. For example, furin, several members of the Matrix Metalloprotease superfamily such as the gelatinase MMP2/9, as well several members of the Cathepsin family of endolysosomal proteases, such as Cathepsin B (CATSB), are highly enriched for in the cancer tissue as opposed to normal tissues (Braun & Sauter, 2019: PMID: 31406574; Jabłońska-Trypuć et al, 2016: PMID: 27028474; Vidak et al, 2019: PMID: 30897858); in some cases, protease enrichment may actually stem from loss of PTEN itself in cancer cells during cancer progression (e.g. Li Y et al, 2018: PMID: 29704427).

Figure 14:
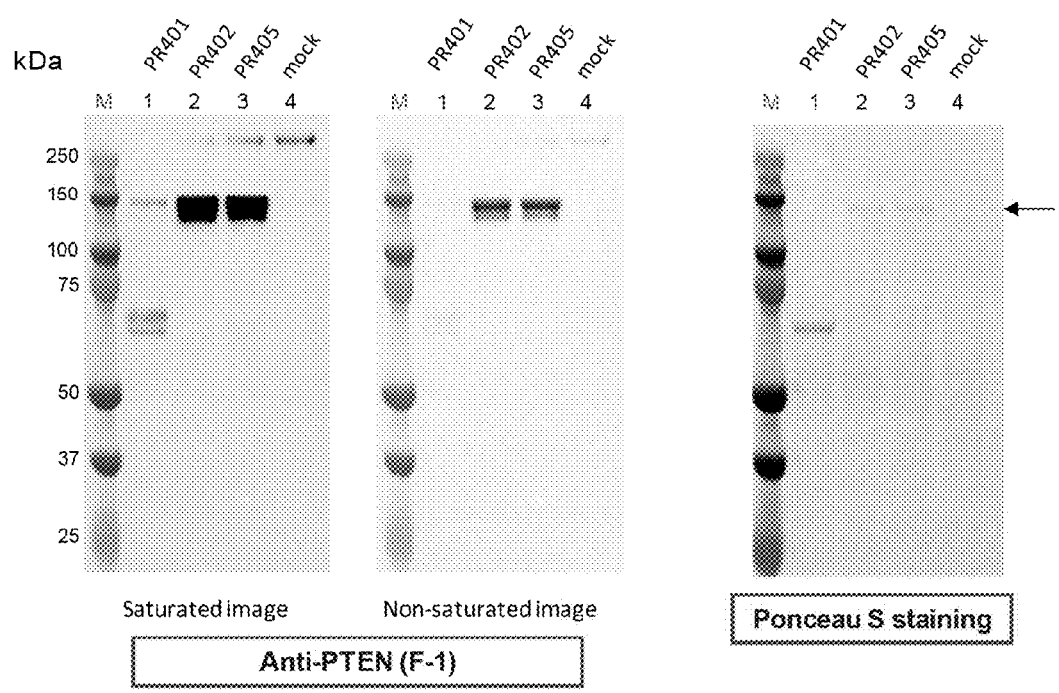
FIG. 14 shows that in-frame addition of a MMP2/9-cleavable linker between the PTEN-L and albumin domains of PR402 results in a fusion protein (PR405) that, like PR402, is protected from cleavage by furin. In contrast, PR401 which contains a furin-cleavable linker at an equivalent position is degraded completely.

The Applicant initially constructed three PRs harboring a consensus MMP2/9 cleavage site (SEQ ID NO:165), namely PR2 (SEQ ID NO:15; cDNA SEQ ID NO:55), PR4 (SEQ ID NO:26; cDNA SEQ ID NO:66) and PR5 (SEQ ID NO:17; cDNA SEQ ID NO:57). However, PR2 (SEQ ID NO:15; cDNA SEQ ID NO:55) was shown to be non-manufacturable, and thus its sensitivity to MMP2/9 digestion could not be addressed; whereas PR4 (SEQ ID NO:26; cDNA SEQ ID NO:66) and PR5 (SEQ ID NO:17; cDNA SEQ ID NO:57) also contain a furin-sensitive linker such as the MCPD (SEQ ID NO:39) or SEQ ID NO:164, which, as shown above is sufficient to cause their complete degradation as well. Hence, to assess the MMP2/9 cleavability of SEQ ID NO:165 in a manufacturable context, the Applicant constructed PR405 (SEQ ID NO:129; cDNA SEQ ID NO:157). PR405 is in all other aspects identical with PR402, except PR405 also contains the SEQ ID NO:165 linker fused in frame between PTEN-L and HSA. FIG. 14 demonstrates that PR405 (SEQ ID NO:129; cDNA SEQ ID NO:157) is manufacturable and, like PR402 appears to be insensitive to furin-mediated degradation. In stark contrast, PR401 [which is identical to PR405 except it contains a linker sequence with a furin consensus site (SEQ ID NO:164 vs SEQ ID NO:165, respectively)] is degraded completely. Thus, the type and sequence of linker inserted between the two moieties of PR402 has a dramatic effect on degradation propensity and hence manufacturability of the resulting fusions, whereas PR402 (SEQ ID NO:28; cDNA SEQ ID NO:68) and PR405 (SEQ ID NO:129; cDNA SEQ ID NO:157) are equivalent from a manufacturing perspective, being both manufacturable.

Along the same lines, and in another embodiment, the Applicant inserted Cathepsin B-sensitive linkers (SEQ ID NO:106-108) in frame between the PTEN-L and HSA domains of PR402 (SEQ ID NO:28; cDNA SEQ ID NO:68), so as to generate PR406 (SEQ ID NO:130; cDNA SEQ ID NO:158), PR407 (SEQ ID NO:131; cDNA SEQ ID NO:159) and PR408 (SEQ ID NO:132; cDNA SEQ ID NO:160), respectively. Like PR402 (SEQ ID NO:28; cDNA SEQ ID NO:68) and PR405 (SEQ ID NO:129; cDNA SEQ ID NO:157), PR406 (SEQ ID NO:130; cDNA SEQ ID NO:158), PR407 (SEQ ID NO:131; cDNA SEQ ID NO:159) and PR408 (SEQ ID NO:132; cDNA SEQ ID NO:160) were all found to be manufacturable as no significant degradation could be noted (results not shown and FIG. 15). Subsequently, these 5 proteins were subjected to in vitro cleavage assays using purified recombinant MMP2 and CATSB.

Materials & Methods pTT5-based PR402 (SEQ ID NO:28; cDNA SEQ ID NO:68), PR405 (SEQ ID NO:129; cDNA SEQ ID NO:157), PR406 (SEQ ID NO:130; cDNA SEQ ID NO:158), PR407 (SEQ ID NO:131; cDNA SEQ ID NO:159) and PR408 (SEQ ID NO:132; cDNA SEQ ID NO:160) expression vectors were transiently transfected in CHO-3E7 cells as described in Example 1. 90 µl of crude culture supernatant obtained at 5 days post-transfection was then mixed with 10 of either 10×MMP2 digestion buffer (500 mM Tris-HCl pH 7.3, 1 M NaCl, 100 mM $CaCl_2$)) or 10×CATSB pH 5.0 buffer [200 mM sodium citrate pH 5.0, 1.5 M NaCl, 50 mM DTT (added fresh before digestion)] or 10×CATSB pH 7.0 buffer (200 mM HEPES pH 7.0, 50 mM DTT (added fresh before digestion)]. The final pH was confirmed with pH paper on each 1× buffered solution. 20 nM (final) recombinant active MMP2 protease (Enzo cat. #BML-SE237-0010; provided at 1.2 mg/ml or 30 µM), or 0.3 µg/ml (final) active CATSB (BioVision #7580-5; provided at 0.5 mg/ml) were then added to each reaction. Immediately thereafter (t=0) or after 4 h or 21 h, 24 µl of each digestion reaction was brought into a separate tube containing 8 µl sample buffer with DTT. Samples were then heated for 10 min at 70° C. and loaded on SDS-PAGE. The gel was blotted with F-1 (anti-PTEN) antibody and an HRP-conjugated secondary antibody, as described previously.

Results

Figure 15A:
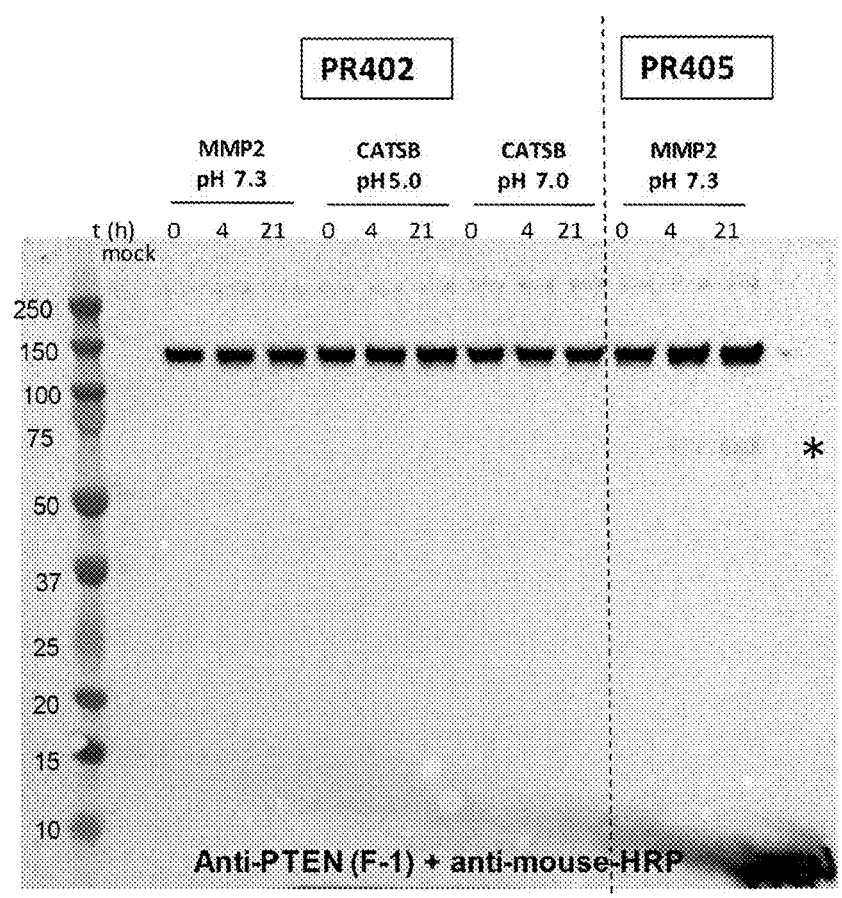
FIGS. 15A to 15C provide result relating to in vitro digestion of PR402, PR405, PR406, PR407 and PR408 and demonstrates sequence and pH-specific fusion cleavage by recombinant MMP2 (PR405 only) and CATSB (PR407, PR408 only) to release PTEN-L-like, 70KDa fragments (stars).
Figure 15B:
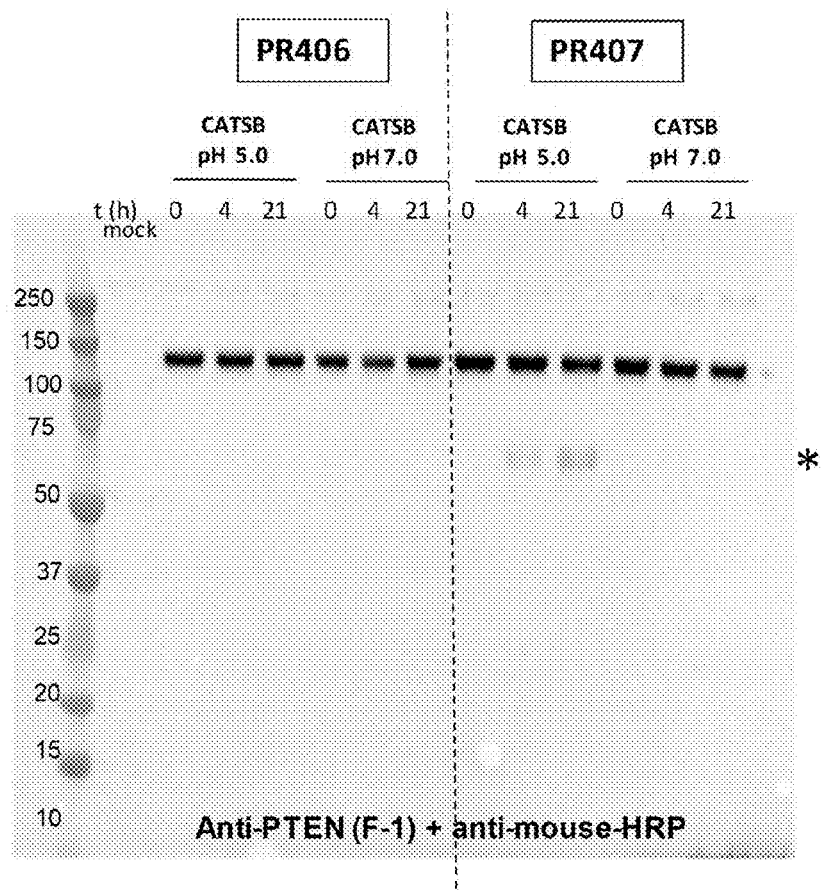
Figure 15C:
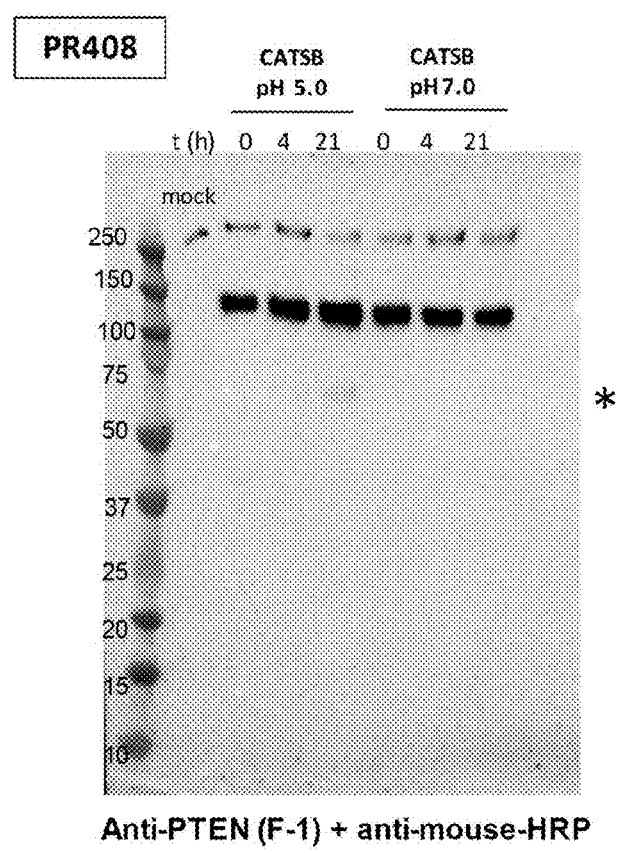

FIG. 15 shows that the expression of PR406 (SEQ ID NO:130; cDNA SEQ ID NO:158), PR407 (SEQ ID NO:131; cDNA SEQ ID NO:159) and PR408 (SEQ ID NO:132; cDNA SEQ ID NO:160) was comparable to that of PR402 (SEQ ID NO:28; cDNA SEQ ID NO:68) in the crude CHO-3E7 supernatants. PR402 was not appreciably cleaved by either recombinant MMP2 or CATSB. MMP2 did however cleave its consensus site (SEQ ID NO:165) on PR405 only; this cleavage released a PTEN-L-like fragment (~70 KDa) that was identified using the anti-PTEN antibody (FIG. 15, star). PR405 (SEQ ID NO:129; cDNA SEQ ID NO:157) was not cleaved by CATSB, demonstrating that SEQ ID NO:165 is specific for the MMP2. In contrast, CATSB cleaved PR407 (SEQ ID NO:131; cDNA SEQ ID NO:159) and PR408 (SEQ ID NO:132; cDNA SEQ ID NO:160) to release a PTEN-L-like fragment at similar amounts (about 20% of total), though it did not cleave PR406 (SEQ ID NO:130; cDNA SEQ ID NO:158). Thus, CATSB is highly specific for PTEN-L-HSA fusions containing preferably the linker with SEQ ID NO:108 or even more preferably the minimal linker with SEQ ID NO:107, wherein the said CATSB linkers are inserted in frame between the C' of PTEN-L and the N' of HSA. Remarkably, CATSB only cleaves PR407 and PR408 at a low pH (FIG. 15), such as the acidic pH known to occur at the pericancerous tissues. This is a particularly relevant embodiment of the present invention because a circulating PTEN-L-(CATSB linker)-albumin fusion dosed intravenously to a subject in need thereof would be cleaved by extracellular CATSB at the acidic pH found at the cancer cites, thereby releasing active PTEN-L, which would penetrate cancer cells via its Minimal Cell Penetration Domain (SEQ ID NO:39) and kill them. In another embodiment, a circulating PTEN-L-(MMP2 linker)-albumin fusion dosed intravenously to a subject in need thereof would be cleaved by extracellular MMP2 found in large amounts at the cancer cites, thereby releasing active PTEN-L, which would penetrate cancer cells via its Minimal Cell Penetration Domain (SEQ ID NO:39) and kill them.

A PTEN-L-(MMP2/9-cleavable linker)-albumin fusion or a PTEN-L-(CATSB-cleavable linker)-albumin fusion is dosed intravenously to a subject, for example, a rodent bearing a human tumor xenograft. In this rodent aminal model, a human tumor cell line is engineered to express a bioluminescent gene, such as Luciferase. One suitable engineered tumor cell line is the PTEN-albumin fusion 4T1-Luc-responsive mouse breast cancer cell line. Co-administered with the tumor cells is an activatable fluorescence imaging agent, including but not limited to the MMPSense 645 FAST(MMP2/9) and Cat B680 FAST(CATSB) protease sensitive imaging agents (FAST platform, PerkinElmer, Waltham, Mass.), respectively. Release of active PTEN-L due to protease action on the fusion at the peri-tumor area is simultaneously detected, quantified and/or correlated with imaging contributed by the protease-sensitive probe acting at the very same cancer site and at the same time. Meanwhile, imaging agent fluorescence intensity further correlates with the loss of Luciferase signaling within the very same tumor site and at the same time, following the release, biodistribution and penetration of active PTEN-L into the tumor cell, as a result of treatment of the subject with the albumin-PTEN fusion, thereby altogether correlating (pre) clinical efficacy response of the subject to the fusion with a tumor imaging biomarker of the cancer in the subject. In yet another experiment, the intact albumin-PTEN-L or albumin-PTEN-S fusion is taken up by cancer cells via cell penetration mediated by the albumin-FcRn receptor system (acting in concert or synergistically with the LUD-mediated penetration in the case of PTEN-L). The internalized albumin-PTEN fusion protein is also digested intracellularly following cleavage by endosomal or lysosomal CATSB, thereby releasing active PTEN protein in the interior of the cancer cell, leading to its death.

In another experiment, the intact albumin-PTEN-L or albumin-PTEN-S fusion is co-administered with the MMPSense 645 FAST(MMP2/9) and Cat B680 FAST (CATSB) protease sensitive imaging agents. The internalized albumin-PTEN fusion protein is taken up by cancer cells via cell penetration mediated by the albumin-FcRn receptor system, while the internalized albumin-PTEN fusion protein is digested intracellularly following cleavage by endosomal or lysosomal CATSB, thereby releasing active PTEN protein in the interior of the cancer cell, leading to its death. Thus, the biodistribution of the fusion, penetration of active PTEN into the tumor cell, (pre)clinical efficacy response of the subject to the fusion drug are directly and measurably correlated with a peri-cancer area-specific imaging biomarker of the tumor in the subject. Also tested is an albumin-PTEN fusion protein containing linkers comprising suitable cleavage sites of cancer related proteases selected from ADAM8, ADAM9, ADAM10, ADAM12, ADAM15, ADAM17/TACE, ADAMDEC1, ADAMTS1, ADAMTS4, ADAMTS5, Aspartate proteases, e.g., BACE, Renin, Aspartic cathepsins, e.g., Cathepsin D, Cathepsin E, Caspases, e.g., Caspase 1, Caspase 2, Caspase 3, Caspase 4, Caspase 5, Caspase 6, Caspase 7, Caspase 8, Caspase 9, Caspase 10, Caspase 14, Cysteine cathepsins, e.g., Cathepsin B, Cathepsin C, Cathepsin K, Cathepsin L, Cathepsin S, Cathepsin V/L2, Cathepsin X/Z/P, Cysteine proteinases, e.g., Cruzipain, Legumain, Otubain-2, KLKs, e.g., KLK4, KLK5, KLK6, KLK7, KLK8, KLK10, KLK11, KLK13, KLK14, Metallo proteinases, e.g., Meprin, Neprilysin, PSMA, BMP-1, MMPs, e.g., MMP1, MMP3, MMP7, MMP8, MMP10, MMP11, MMP12, MMP13, MMP14, MMP15, MMP16, MMP17, MMP19, MMP20, MMP23, MMP24, MMP26, MMP27, Serine proteases, e.g., activated protein C, Cathepsin A, Cathepsin G, Chymase, coagulation factor proteases, (e.g., FVIIa, FIXa, FXa, FXIa, FXIIa), Elastase, Granzyme B, Guanidinobenzoatase, HtrAl, Human Neutrophil Elastase, Lactoferrin, Marapsin, NS3/4A, PACE4, Plasmin, PSA, tPA, Thrombin, Tryptase, uPA, Type II Transmembrane, Serine Proteases (TTSPs), e.g., DESC1, DPP-4, FAP, Hepsin, Matriptase-2, MT-SP1/Matriptase, TMPRSS2, TMPRSS3, TMPRSS4. In one experiment, intracellular digestion of the PTEN-albumin fusions is mediated by a protease like furin.

Figures 16A, 16B:
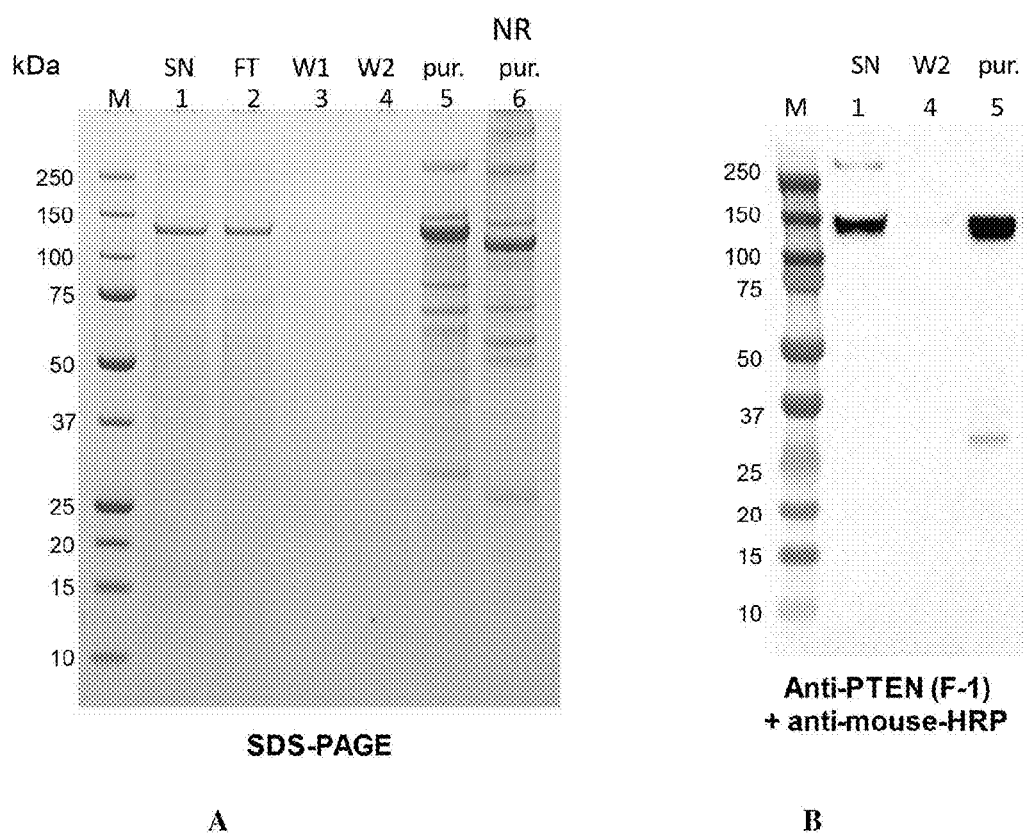
FIGS. 16A to 16B provide evaluation on PR402 production.

Example 3. Manufacturing & Purification Scouting of PTEN Human Serum Albumin Fusions 1LT of CHO-3E7 cells growing in animal origin-free, protein-free, and chemically defined were transiently transfected with pTT5-PR402 (SEQ ID NO:28; cDNA SEQ ID NO:68) and grown at 32° C. in suspension, exactly as described in Durocher & Loignon, 2009 (patents.google.com/patent/US8637315). Cells and media were collected 4 days post-transfection. Viability upon collection was 75.5% as assayed by Accumax (Innovative Cell Technologies, Inc.). The supernatant was loaded directly on a 2 ml nickel-sepharose column. The flow through of the column (950 ml) was collected and the column was washed first with 12 ml of (300 mM NaCl, 50 mM NaPO$_4$ pH 7.0) and then with 12 ml of (300 mM NaCl, 10 mM imidazole, 50 mM NaPO$_4$ pH 7.0) buffer. PR402 was eluted in fractions of 0.5 ml with (300 mM imidazole, 300 mM NaCl, 50 mM NaPO$_4$ pH 7.0. Best fractions (#4 to 15) containing the protein (as determined by Nanovue) were pooled and desalted in TNE buffer (50 mM Tris, 150 mM NaCl, 1 mM EDTA pH 7.4), filter sterilized, quantified by Nanodrop, aliquoted and frozen at −80° C. As shown in FIG. 16, a portion of PR402 (130 KDa) escaped in the flow through (SDS-PAGE, lanes 1-2), whereas some impurities and degradation products were also apparent in the final, semi-purified preparation (lanes 5 and 6; samples were run in reducing and non-reducing SDS-PAGE, respectively). Thus, PTEN albumin fusions tagged with 6xHis (SEQ ID NO: 222) can be purified with IMAC to about 50% purity.

In another embodiment, pTT5-PR405 (SEQ ID NO:129; cDNA SEQ ID NO:157) was transiently transfected in 40 ml HEK293 cells grown in suspension for 5 days. The supernatant was then diluted with 4 volumes (160 ml) of buffer A (20 mM sodium phosphate; 150 mM NaCl, 2 mM DTT pH 5.8) and then loaded on 1 ml Cibacron Blue Sepharose (GE HiTrap™ Blue HP) column. The column was washed with 8 ml buffer A and bound proteins were eluted in 2 steps: first by adding 8 ml of buffer B (20 mM sodium phosphate; 2 mM DTT, 1M NaCl pH 5.8), whereby 7 fractions of 4 ml each were collected; and then by adding 8 ml of buffer C (20 mM sodium phosphate; 2 mM DTT, 2M NaCl pH 5.8), whereby 6 fractions of ~5 ml each were collected. Aliquots of each fraction were loaded on SDS-PAGE and the gel was blotted with anti-6xHis antibody.

Figure 17A:
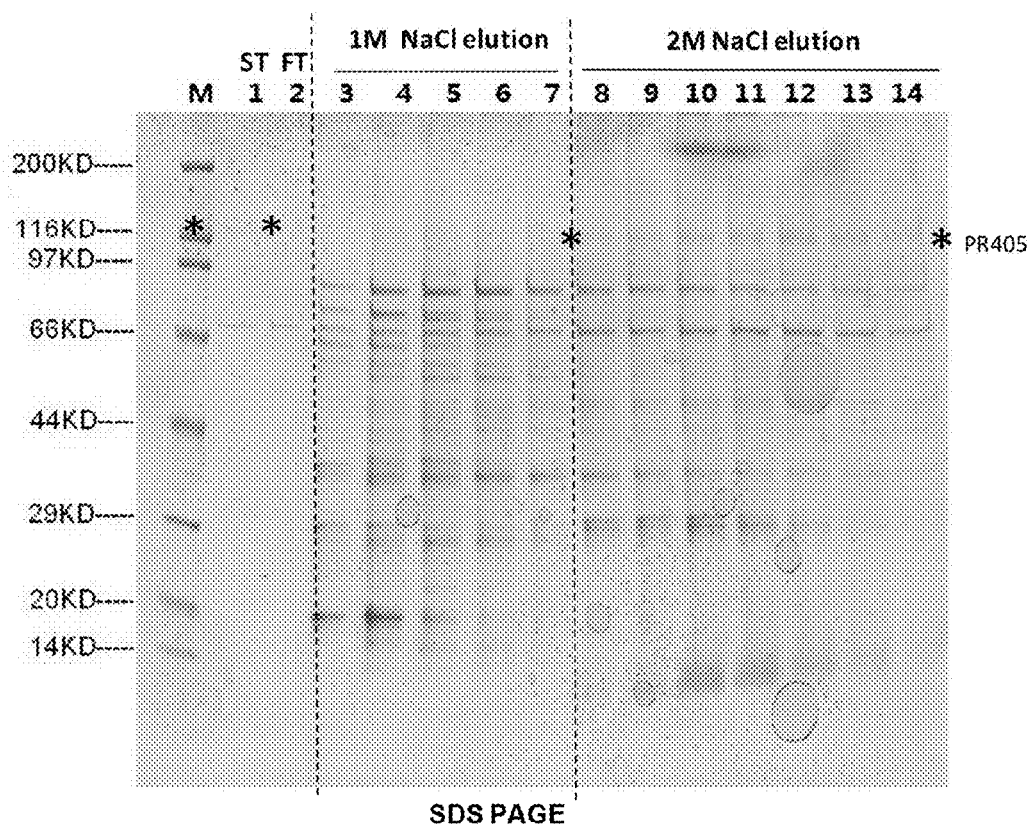
FIGS. 17A to 17E provide evaluation on PR405 production. Manufacturing and purification scouting of PR405 (denoted by stars) by Cibacron Blue albumin affinity chromatography (FIGS. 17A-17B), followed by heparin affinity chromatography to remove albumin degradants (denoted by crosses) (FIGS. 17C-17D), leading to substantially pure PR405 (FIG. 17E) ST: Starting Material of the column; FT: Flow Through of the column; bD: pooled sample before dialysis; DP: dialysis precipitate solubilized in Laemmli buffer showing that PR405 remained soluble during dialysis; W: column wash; P: positive control 6xHis-tagged protein ("6xHis" disclosed as SEQ ID NO: 222). Shown are SDS-PAGE gels for FIGS. 17A-17D and WB (anti-6xHis) for FIGS. 17A-E.
Figure 17B:
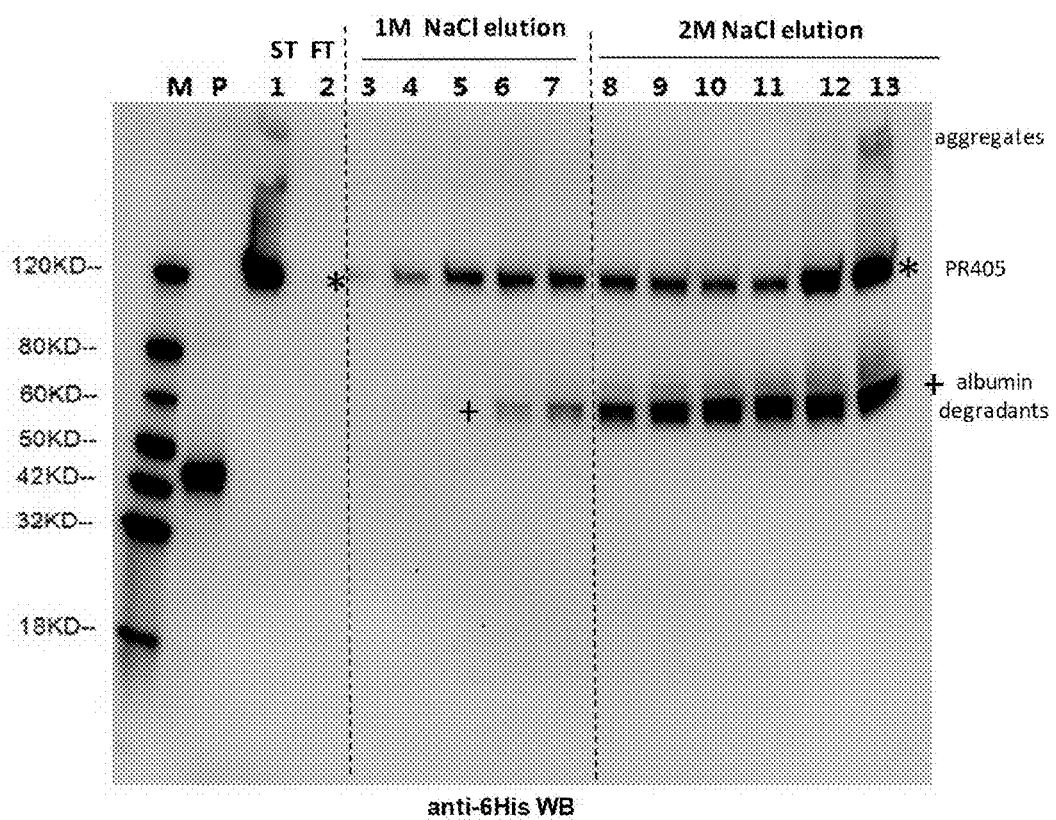

As seen in FIGS. 17A-17B, PR405 bound Cibacron Blue quantitatively (lanes 1 and 2). PR405 could then be eluted from the column above 1M NaCl and up to 2M NaCl (lanes 3-13). As expected from the fact that the Cibacron Blue dye has high affinity for albumin, albumin degradants of 60-65 KDa (similar to the size of mature HSA, consistent with degradation of the PR405 fusion to its two major domains) can also bind and elute from the column (FIGS. 17A: 17B, crosses). However, the albumin degradants can be subsequently removed by heparin-affinity chromatography, as follows.

Figure 17C:
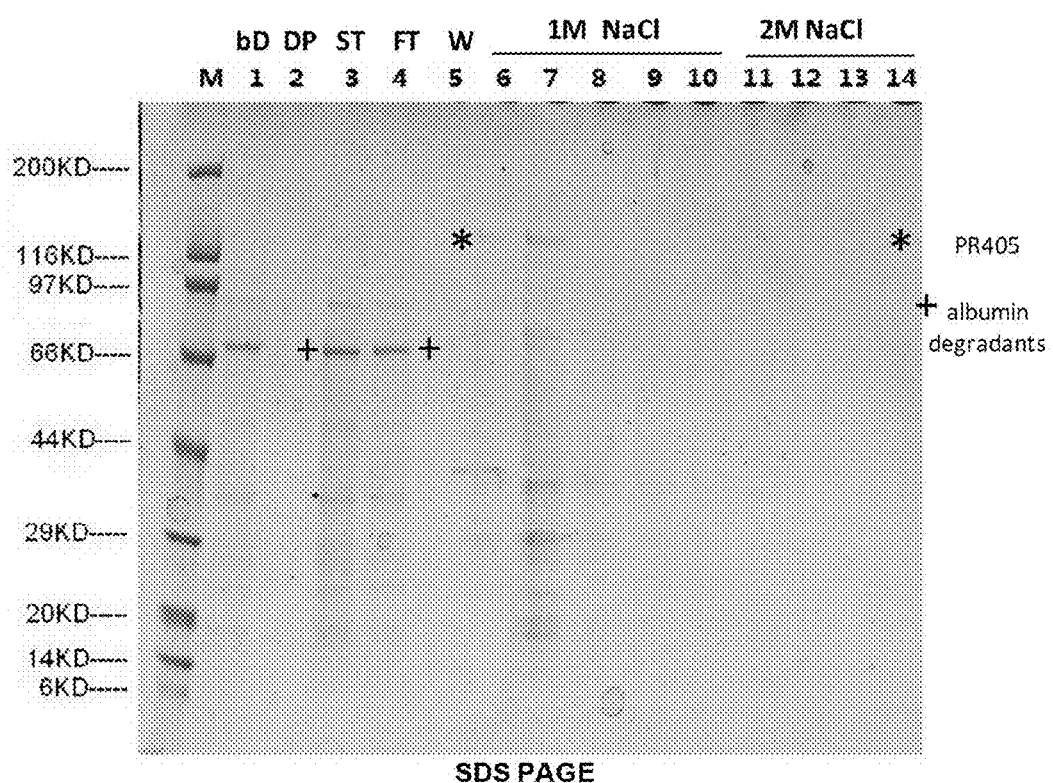
Figure 17D:
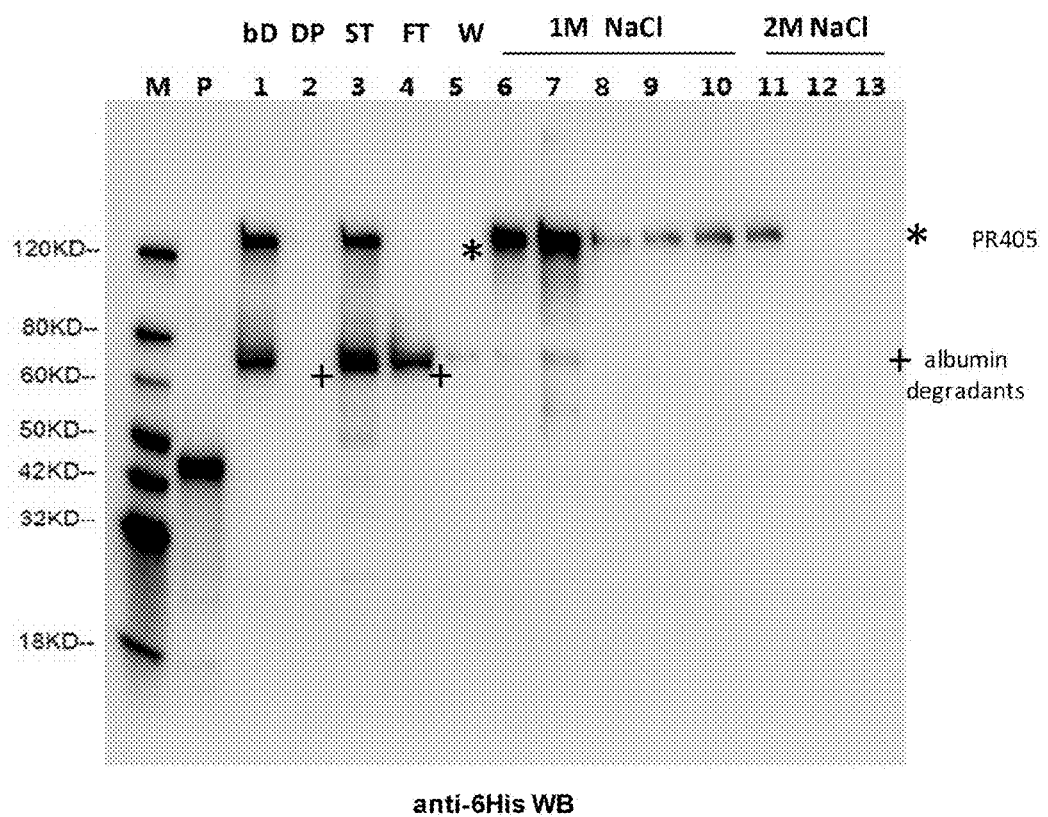
Figure 17E:
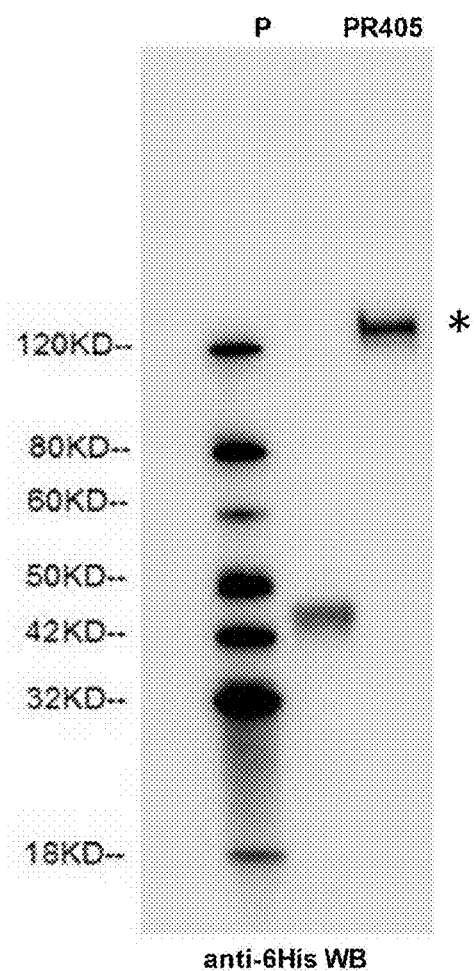

Fractions 6-13 of the Cibacron Blue column eluate were pooled and dialyzed overnight into buffer D (20 mM sodium phosphate; 0.15 M NaCl, 2 mM DTT, pH 6.1). The dialyzed solution was then loaded onto 1 ml Heparin-Sepharose 6 Fast Flow resin (General Electric)equilibrated in buffer D. The column was washed with 8 column volumes (CV) of buffer D, and then eluted with 2 steps of NaCl; first by applying 5 CV of buffer E (20 mM Na phosphate; 1.0 M NaCl, 2 mM DTT, pH 6.1) and then by applying5 CV of buffer F (20 mM sodium phosphate; 2.0 M NaCl, 2 mM DTT, pH 6.1). Aliquots of each fraction were loaded on SDS-PAGE and the gel was blotted with anti-6xHis antibody. As seen in FIGS. 17C-17D, the great majority of the albumin degradants are excluded from the heparin (lanes 3-5), from which PR405 can now be eluted in substantially enriched form at about 1M NaCl (FIGS. 17C-17D, lanes 6-11 and FIG. 17E).

Given the high salinity required to elute PR405 from both columns, is anticipated that addition of NaCl concentration up to 0.75M (or use of a stronger salt than NaCl per the Hofmeister series) in the wash buffer would facilitate more efficient removal of host cellular proteins (FIGS. 17A-17B, lanes 3-14), leading to a better enrichment of the PTEN protein fusion to be purified.

Figure 18:
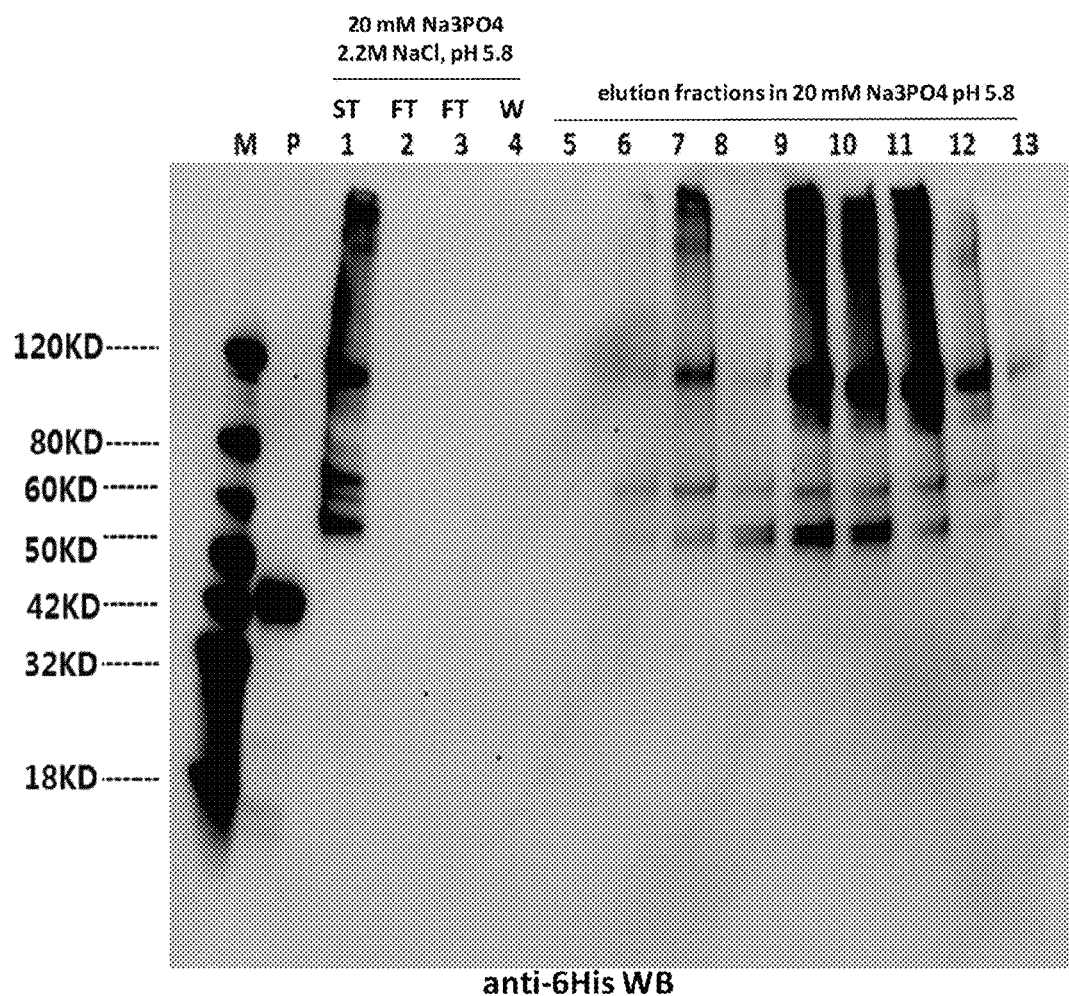
FIG. 18 shows purification scouting of an aged batch of PR402 on Hydrophobic Interaction Chromatography. PR402 binds the column in the presence of high salt and can be eluted therefrom by reduction of salt concentration. P: positive control 6xHis-tagged protein ("6xHis" disclosed as SEQ ID NO: 222).

In another embodiment, a rather aged (8-month old batch kept at −20° C.), IMAC-purified sample of PR402 (see above) was dialyzed into (20 mM sodium phosphate pH 5.8, 2.2M NaCl) buffer and then absorbed onto a 5 ml HiTrap™ Phenyl (Low Sub FF) Hydrophobic Interaction Chromatography (General Electric) prequilibrated in the same buffer. The column was washed twice in binding buffer and bound proteins were eluted with 5CV of (20 mM sodium phosphate pH 5.8). Aliquots of starting material, flow through, wash and eluate were loaded on SDS-PAGE; the gel was blotted with anti-His. As shown in FIG. 18, PR402 can quantitatively bind the column, from which it can be eluted upon reduction of the ionic strength.

In one embodiment, the albumin PTEN fusion protein to be purified is captured by Cibacron Blue Affinity Chromatography, eluted in high salt, dialyzed and bound to Heparin Affinity Chromatography.

In another embodiment, the PTEN fusion protein is captured by Albupure Affinity Chromatography (ProMetic Bio- Sciences Ltd, UK), according to the published instructions of the manufacturer, wherein Albupure Affinity Chromatography has been developed for highly enriching purification of albumin fusions like the PTEN fusion proteins claimed herein.

In another embodiment, the PTEN fusion protein is purified orthogonally by employing a sequence of columns consisting of: capture of the fusion protein by Heparin Affinity Chromatography, such that the albumin degradants are removed in the column flowthrough, elution of the fusion protein in high salt (around 0.75M NaCl); direct absorption of the eluate onto Cibacron Blue Affinity Chromatography, elution of the fusion from Cibacron Blue in about 2M NaCl; followed by direct absorption of the eluate onto Phenyl Sepharose Hydrophobic Interaction Chromatography, from which the PTEN fusion protein can be eluted in low/physiological salt and brought into a pharmaceutically acceptable buffer.

Even though an aged preparation of PR402 contained aggregates, the freshly manufactured batch of PR402 of FIG. 16 migrates as a monomer of 120-130 KDa on both reducing and non-reducing gel electrophoresis, whereby the high MW bands seen on SDS-PAGE appear to be contaminants instead of aggregates since these bands are not visualized by anti-PTEN WB (FIG. 16). This suggests that the native state of the albumin-PTEN fusions is monomeric.

The main band of 130 KDa was excised from the gel of FIG. 16, solubilized, digested with trypsin or chymotrypsin and sequenced by LC/MS, according to standard procedures in the art (FIG. 19). The results showed a perfect (99.6%) match with the expected sequence (SEQ ID NO:28). Quite importantly, the N-terminal peptide [SESP . . . PPTR] ("SESP" disclosed as residues 25-28 of SEQ ID NO: 28 and "PPTR" disclosed as residues 47-50 of SEQ ID NO: 28) (see FIG. 19A) was identified, which confirms the desired sequence N-terminus of the mature PR402 (SEQ ID NO:28; cDNA SEQ ID NO:68), thereby demonstrating the HSA Signal Peptide (SEQ ID NO:93) can mediate correct translocation of the fusion protein through the ER and TGN, followed by its cleavage and secretion of mature PR402 (SEQ ID NO:28; cDNA SEQ ID NO:68) in the supernatant of CHO cells.

Several methionine residues of PR402 were found to be oxidized, as assayed by LC/MS, which may contribute to the 10 KDa difference in migration between the reduced and the non-reduced form (FIG. 16, lanes 5-6). In addition, several Asn residues were found to be deamidated, which is consistent with the predicted behavior of this residue in the mildly alkaline buffer (TNE pH 7.4) used to purify PR402 (FIG. 16).

Because PTEN-L cannot besystematically manufactured in bacteria in an industrially relevant form, and since it is known that N- and O-linked glycosylations found in higher species may stabilize (bacterially expressed) proteins both from physicochemical as well pharmacokinetic/renal clearance perspective, the Applicant also determined PR402's sugar modifications with an emphasis on the LUD (SEQ ID NO:5). As was previously bioinformatically predicted (Malaney et al, 2013: PMID: 24056727),the LUD of PR402 was found to be heavily O-glycosylated. However, the actual O-sugar bearing residues were substantially different than those predicted by Malaney et al. Specifically, the PR402 LUD(SEQ ID NO:5) was found to contain several mucin-like O-linked glycans, such as Tn, Tf, sialyl-T and di-sialyl T structures (for review of these glycan modifications see Kudelka et al, 2015; PMID: 25727146) on 9 LUD residues, as follows (numbering after SEQ ID NO:1): S65, S85, 5115, S117, S129, T140, S161, S164 and S168 (FIGS. 19B-19C).

To ensure that these O-glycans are indeed representative of the LUD, the Applicant contructed F137 (SEQ ID N0:133; cDNA SEQ ID NO:161), which expresses the p53 tumor suppressor instead of PTEN-S, wherein the p53 domain of F137 is placed in exactly in the same position and orientation within the PR402 backbone. F137 was purified by IMAC as shown in FIG. 16 (results not shown). The monomeric F137 fusion protein was extracted from the gel and sequenced with LC/MS, as above. It was found that the F137 LUD bears similar O-glycan modifications on the same residues of the LUD, except for 5135 (FIGS. 19B-19C). In addition, the F137 LUD had 4 additional O-sugar sites (FIGS. 19B-19C), which are not present on the PR402 LUD. Thus, the human LUD appears to be naturally O-glycosylated on several residuesmainly including but not limited to S65, S85, S115, S117, S129, T140, S161, S164 and S168. In contrast, expression of the PTEN-L fusion in insect cells (FIG. 5) results in a completely aberrant and significantly poorer O-glycan profile (FIGS. 19B-19C). As such, even if an insect PTEN-L fusion were manufacturable, it would cause significant immunogenicity upon injection in a subject.

In another aspect, the presence of highly sulfated O-glycan antennas on the PR402 LUD would be anticipated to introduce several negative charges locally, which would practically lower the effective pI of the wild-type LUD (predicted to be at 11.55) substantially, toward the pI of PTEN-S, which is 5.94. In such an embodiment, simultaneous mutation of S65, S85, S115, S117, S129, T140, S161, S164 and S168 to aspartate or glutamate would lead to a mutated human LUD (SEQ ID NO:134) having a stand-alone pI of 9.29 and, which, when fused to PTEN-S (SEQ ID NO:2) would lead to "sialylated-like" PTEN-L with a calculated pI of 6.33.

In another embodiment, mutation of S65, S85, S115, S117, S129, T140, S161, S164 and S168 to aspartate or glutamate can be engineered in a bacterial expression vector to render the resulting bacterially expressed protein human-like and substantially more stable physicochemically.

In other embodiments, one, two or more or all of O-glycan bearing LUD residues may be mutated to aspartate or glutamate, thereby lowering the pI of the resulting human protein to improve its pharmacokinetic properties, wherein the said residues to be mutated are selected from S65, S85, S115, S117, S129, T140, S161, S164 and S168 of SEQ ID NO:1.

In another aspect, the Applicant determined potential glycosylation sites on the PTEN-S moeity of PR402. As shown in FIG. 19D, like the LUD, PTEN-S expressed in CHO-3E7 cells in the PR402 background is also O-glycosylated, though to a much lower extent than the LUD. The PTEN-S tail (aa 350-403; PTEN-S numbering; SEQ ID N0:2) bears most O-linked sites, in line with the tail's regulatory activity. In addition, N292 (PTEN-S numbering) is decorated with 4 similar N-glycans; such N-linked structures are occassionally found on proteins expressed in CHO cells. Despite the vast literature on PTEN-S, however, there is no report on thepotential involvement or relevance of PTEN-S's N292 in protein stability or cancer, suggesting that this residue could be potentially mutated to alleviate O-glycan heterogeneity if needed, thereby potentially facilitating analytical process development of PR402-like or PR61-like fusions.

Example 4. The PTEN Albumin Fusion Proteins are Functional Cell Penetrating Tumor Suppressors The Applicant then determined whether the PTEN albumin fusions disclosed herein possess tumor suppressor function.

Figure 20A:
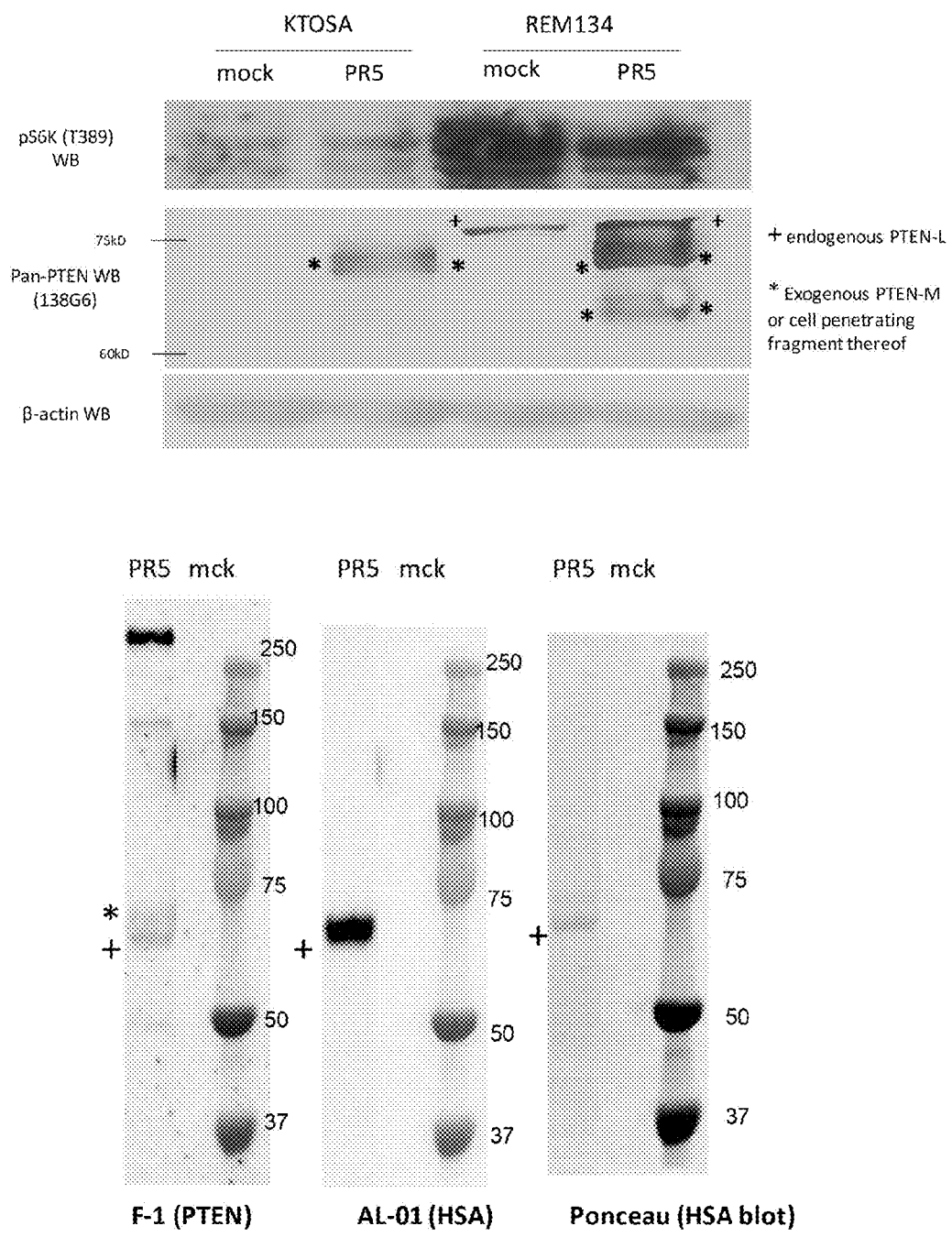

In one embodiment, a very poor by industrial standards (i.e, very crude, dilute and debris-containing) supernatant from either PR5 (SEQ ID NO:17; cDNA SEQ ID NO:57), or mock-transfected HEK293 cells (see FIG. 8B) was placed directly onto the surface of KTOSA, a PTEN null cancer cell line (FIG. 20A, upper panel, left) or REM134, a PTEN-S-null cancer cell line that apparently still expresses PTEN-L, for 4 h. Cells were then washed, lysed and cell extracts blotted with the indicated antibodies (FIG. 20A). It was found that a PTEN-M-like, 70 KDa protein contained in the PR5 supernatants (see FIG. 8B) entered both cell lines (FIG. 20A; upper panel, middle set). This PR5-generated PTEN-M appeared to be of full length because it migrated at the expected MW (~70 KDa), just below the endogenous REM134 PTEN-L protein. REM134 cell extracts contained two additional bands at around 65 KDa, which are likely degradation products of exogenous PTEN-M, since no equivalent bands exist in the KTOSA lysate. Importantly, the PR5-released, cell penetration-competent PTEN-M mediated detectable downregulation of pS6K phosphorylation in REM134 cells [pS6K is a known pharmacodynamic (PD) target of exogenously applied PTEN-L protein drug; Hopkins et al, 2013: PMID: 23744781. This PD effect of PTEN-M becomes even more prominent if one takes into account that PR5 supernatants used in this experiment contained essentially only HSA and little if any PTEN-M (FIG. 20A, lower panel). Thus, minute amounts of cell penetrating PTEN may exert a significant pharmacodynamic effect in cancer cells.

In one embodiment, the PTEN-albumin fusion that releases exogenous, cell-penetrating PTEN, such as PTEN-L and PTEN-M, leading to favorable regulation of the target cancer cell pharmacodynamics in a subject, is PR405 (SEQ ID NO:129; cDNA SEQ ID NO:157), wherein the said fusion circulates in the blood of the subject and is degraded into cell-penetrating PTEN by the action of a protease like MMP2/9, wherein such protease is abundant in the peri-cancerous tissue of the subject, but much less so in normal tissues of the subject.

In another embodiment, the PTEN-albumin fusion that releases exogenous, cell-penetrating PTEN, such as PTEN-L and PTEN-M, leading to favorable regulation of the target cancer cell pharmacodynamics in a subject, is PR407 (SEQ ID NO:131; cDNA SEQ ID NO:159), or PR408 (SEQ ID NO:132; cDNA SEQ ID NO:160), wherein the said fusion circulates in the blood of the subject and is degraded into cell-penetrating PTEN by the action of a protease like Cathepsin B, wherein such protease is abundant in the acidic, peri-cancerous tissue of the subject, but much less so in the mildly alkaline, physiological normal tissue of the subject.

In another embodiment, the subject protease that, when a PTEN-albumin fusion that is dosed into a subject, releases exogenous, cell-penetrating PTEN, from the fusion, such as PTEN-L and PTEN-M, leading to favorable regulation of the target cancer cell pharmacodynamics in the subject, is a protease selected from ADAM8, ADAM9, ADAM10, ADAM12, ADAM15, ADAM17/TACE, ADAMDEC1, ADAMTS1, ADAMTS4, ADAMTS5, Aspartate proteases, e.g., BACE, Renin, Aspartic cathepsins, e.g., Cathepsin D, Cathepsin E, Caspases, e.g., Caspase 1, Caspase 2, Caspase 3, Caspase 4, Caspase 5, Caspase 6, Caspase 7, Caspase 8, Caspase 9, Caspase 10, Caspase 14, Cysteine cathepsins, e.g., Cathepsin B, Cathepsin C, Cathepsin K, Cathepsin L, Cathepsin S, Cathepsin V/L2, Cathepsin X/Z/P, Cysteine proteinases, e.g., Cruzipain, Legumain, Otubain-2, KLKs, e.g., KLK4, KLK5, KLK6, KLK7, KLK8, KLK10, KLK11, KLK13, KLK14, Metallo proteinases, e.g., Meprin, Neprilysin, PSMA, BMP-1, MMPs, e.g., MMP1, MMP3, MMP7, MMP8, MMP10, MMP11, MMP12, MMP13, MMP14, MMP15, MMP16, MMP17, MMP19, MMP20, MMP23, MMP24, MMP26, MMP27, Serine proteases, e.g., activated protein C, Cathepsin A, Cathepsin G, Chymase, coagulation factor proteases, (e.g., FVIIa, FIXa, FXa, FXIa, FXIIa), Elastase, Granzyme B, Guanidinobenzoatase, HtrAl, Human Neutrophil Elastase, Lactoferrin, Marapsin, NS3/4A, PACE4, Plasmin, PSA, tPA, Thrombin, Tryptase, uPA, Type II Transmembrane, Serine Proteases (TTSPs), e.g., DESC1, DPP-4, FAP, Hepsin, Matriptase-2, MT-SP1/Matriptase, TMPRSS2, TMPRSS3 and TMPRSS4.

In another experiment, the intact albumin-PTEN-L or albumin-PTEN-S fusion is co-administered with the MMPSense 645 FAST(MMP2/9) and Cat B680 FAST (CATSB) protease sensitive imaging agents. The internalized albumin-PTEN fusion protein is taken up by cancer cells via cell penetration mediated by the albumin-FcRn receptor system, or PTEN-L's cell penetration domain, while the internalized albumin-PTEN fusion protein is digested intracellularly following cleavage by endosomal or lysosomal CATSB, thereby releasing active PTEN protein in the interior of the cancer cell, leading to its death. The biodistribution of the fusion, penetration of active PTEN into the tumor cell, (pre)clinical efficacy response of the subject to the fusion drug are directly and measurably correlated with a peri-cancer area-specific imaging biomarker of the tumor in the subject. In another experiment, to assess whether the observed PD effects elicited by the albumin PTEN fusions also correlate with measurable & tangible tumor suppressor effects, such as cancer cell death, the Applicant set up a cell-based assay in the PTEN null, PC3 human prostate cancer cell line. One way tumor suppressors kill cancer cells is by initiating apoptosis via cleavage of an inactive cytoplasmic pro-caspase 3 enzyme to release the smaller, apoptosis executing CASP3 enzyme, which then commits the cell to destruct itself via apoptosis. This property has been harnessed in various commercial cell-based assay kits, whereby activation of a Luciferase-tagged apoptotic CASP3 or CASP7 enzymes can be measured quantitatively in the cell lysate by means of a luminometer.

Figure 20B:
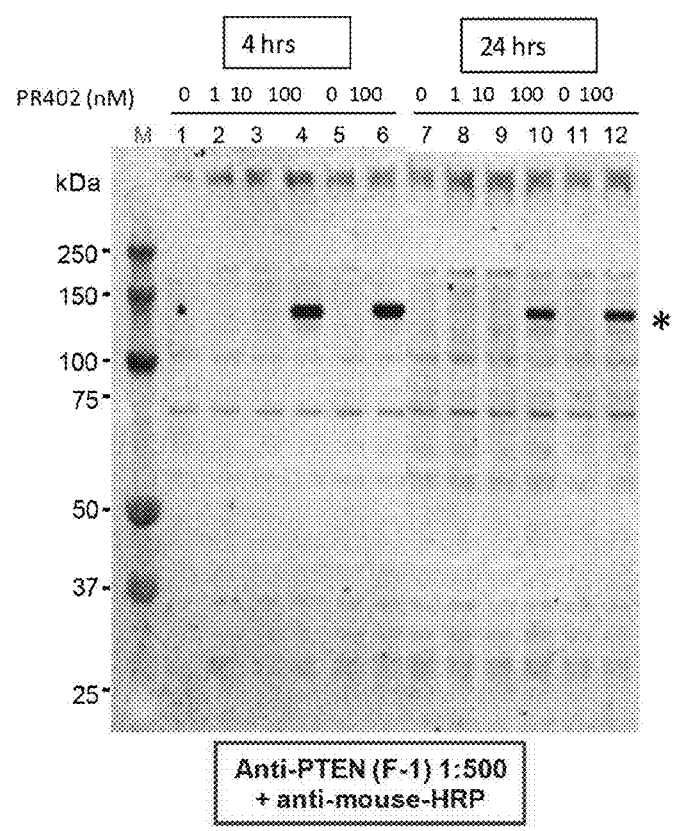

It was first confirmed that, as expected from Applicant's results, PR402 (SEQ ID NO:28; cDNA SEQ ID NO:68) indeed enters PC3 cells following treatment of the cells for 4 h or 24 h (FIG. 20B, lanes 1 vs. 4 and 7 vs. 10). Subsequently, the Caspase-Glo® 3/7 Assay System (Promega Corp, catalog #G8090) was optimized to measure PR402-mediated cancer cell death, as follows: 600 PC-3 cells growing in F12K medium supplemented with 10% FBS were plated in 96-well plates in the same medium overnight. On the next day, the medium was removed and substituted with 0.1 ml of (F12K+0.5% FBS; i.e., serum-free) medium. PR402 was then added to the cells at the appropriate concentration and for the desired time (typically 1-4 h). At the end of the incubation, the drug solution was removed, cells were washed twice in 0.2 ml of serum-free medium and then left sitting at room temperature. 0.1 ml of the Caspase 3/7 Glo reagent prepared according to the instructions of the manufacturer was then added to each well. Wells were shaken gently and further incubated at room temperature for 30 minutes to allow for cell lysis. The luminescence signal of each sample lysate was measured in triplicate using a plate reader. Blank values were subtracted from all measurements.

Figure 20C:
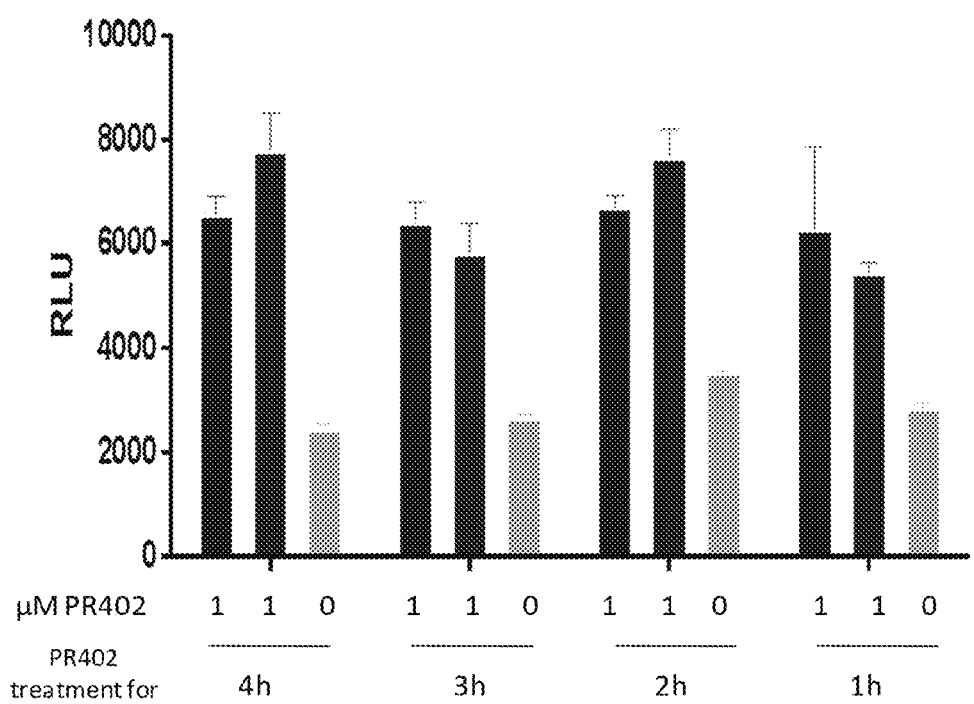
Figure 20D:
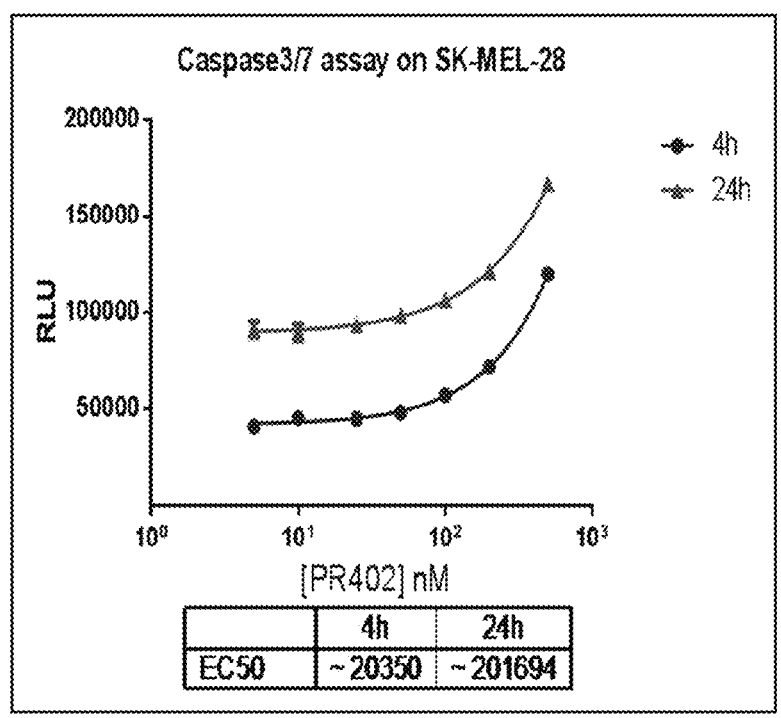

Using this protocol, the Applicant surprisingly found that when two distinct batches of PR402 (SEQ ID NO:28; cDNA SEQ ID NO:68) fusion (both manufactured according to Example 3) were put into contact with PC3 cells, they both resulted in robust CASP3/7 activation at similar levels (FIG. 20C). In fact, PR402 (SEQ ID NO:28; cDNA SEQ ID NO:68) appears to require just 1 h of contact with the cell monolayer to initiate apoptosis, whereby no major additional enhancement of cell death occurs upon longer incubations, i.e., up to 4 h (FIG. 20C). Consistent with its PC3 cell killing capability, exogenous PR402 (SEQ ID NO:28; cDNA SEQ ID NO:68) was found to also initiate cell death of other PTEN null cells such as SK-MEL-28 (melanoma; FIG. 20D), MSTO-211 (mesothelioma) and A2780 (ovarian carcinoma) (results not shown).

Figure 20E:
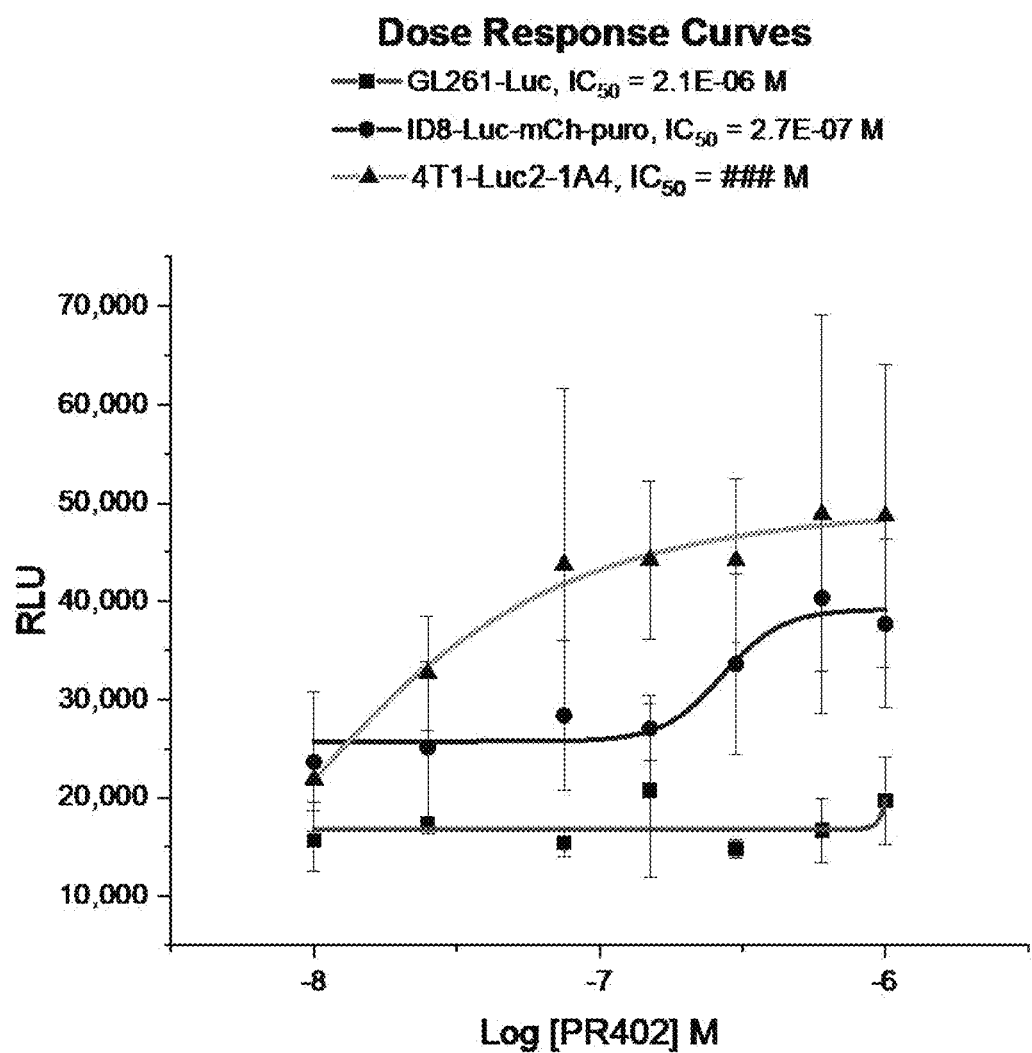

About 30-50% of all cancer patients are totally null for the PTEN tumor suppressors, regardless of indication, as assayed by the complete absence of PTEN immuno-histochemical reactivity (referred to as H score, wherein H<20) using pan-PTEN antibodies such as 138G6 and SP218 (Pulido et al, 2019; PMID: 31501265). For their part, patients contributing seemingly normal H scores, may still contain dysfunctional or inactivated or even cancer-promoting PTEN variants. The latter phenotypes are typically generated via point mutations on the PTEN proteins and are both very challenging to detect by antibody-based methods as well as potentially more difficult to treat than the PTEN null phenotypes (Leslie & Longy, 2016: PMID: 26827793). However, as shown in FIG. 20E, PR402 (SEQ ID NO:28; cDNA SEQ ID NO:68) initiates cell death also of cancer cell lines that have apparently normal endogenous PTEN, such as 4T1 mouse triple negative breast cancer (Zhao et al, 2013; PMID: 23951172) and ID-8 mouse ovarian carcinoma. Thus, the PTEN albumin fusions provided for herein can kill cancer cells regardless of the underlying status of the endogenous PTEN proteins of the subject.

Figure 20G:
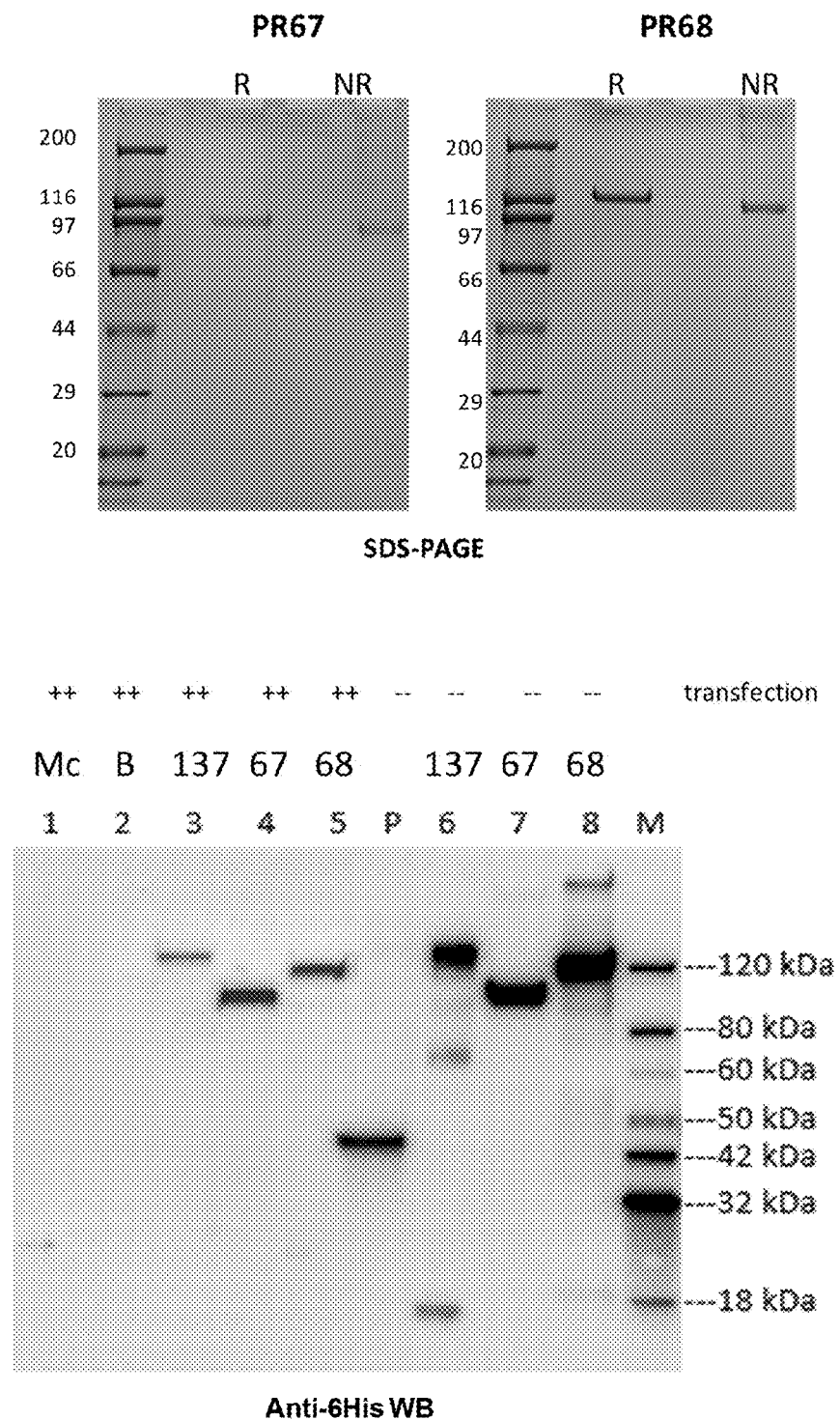
Figure 20H:
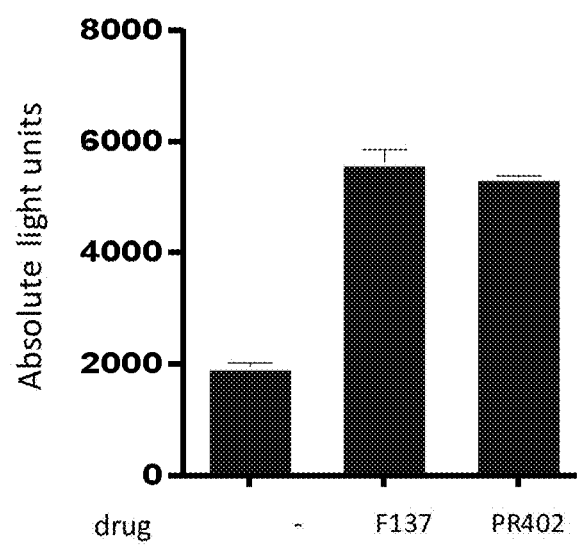

In another aspect, the Applicant surprisingly found that when a PR61-containing CHO-3E7 supernatant was brought into contact with a PC3 cell monolayer for 2 h, a relatively high amount of PR61 (SEQ ID NO:19; cDNA SEQ ID NO:59) was able to enter cells, whereas the control, empty-vector (i.e., pTT5; SEQ ID NO:173) transfected CHO-3E7 supernatant provided no anti-6×His immunoreactivity (FIG. 20F, upper panel, lanes 2 vs. 4). What's more, PR61 (SEQ ID NO:19; cDNA SEQ ID NO:59) was able to initiate cell death, as measured by activation of CASP3/7 (FIG. 20F, lower panel). Because PTEN-S has no known cell-penetration capacity, the latter must be mediated by albumin. To test which albumin domain is responsible for cell entry of PR61-like fusions, PR67 (SEQ ID NO:127; cDNA SEQ ID NO:155) and PR68 (SEQ ID NO:128; cDNA SEQ ID NO:156) were semi-purified via IMAC and then brought onto contact with PC3 cells. As shown in FIG. 20G, and quite surprisingly, both fusions entered PC3 cells within 1 h of incubation. Thus, PR61-like and PR67-like HSA-PTEN-S fusions are able to enter cancer cells and kill them. Moreover, the Minimal Human Serum Albumin domain (SEQ ID NO:163) is sufficient to mediate the functional (anti-cancer) properties of PR61-like fusions including but not limited to PR67 (SEQ ID NO:127; cDNA SEQ ID NO:155) and PR68 (SEQ ID NO:128; cDNA SEQ ID NO:156).

Albumin dIII is apparently redundant with respect to both the stabilization and cell entry of PTEN-S fusions (such as PR67; FIGS. 13 & 20G). In contrast, dIII is required for maximal PR402 stabilization, whereas PR402 (SEQ ID NO:28; cDNA SEQ ID NO:68) is even more destabilized when dII is removed as well (FIG. 12C, PR413, PR414). Thus, albumin interacts with similar, yet also distinct ways with PTEN-Sand PTEN-L that a skilled person in the art could not have possibly predicted prior to conducting the experiment.

In yet another aspect, because the relative cytotoxic ability of albumin-PTEN-L fusions vs. the wild-type, unfused PTEN-L cannot be determined [(since the latter cannot be systematically made in soluble and pure form (see FIGS. 1-5 & 7)], the Applicant instead compared PR402 (SEQ ID NO:28; cDNA SEQ ID NO:68) with F137 (SEQ ID NO:133; cDNA SEQ ID NO:161) in the CASP3/7 assay. Such a comparison actually makes more sense, because both fusions contain albumin as a partner and in the same relative position. As shown in FIG. 20F, identical amounts of IMAC-purified PR402 appear to initiate similar levels of PC3 cell death. Taking into consideration the structural results of FIG. 19, it would appear that PR402 (SEQ ID NO:28; cDNA SEQ ID NO:68) with F137 (SEQ ID NO:133; cDNA SEQ ID NO:161) are functionally bioequivalent. Collectively, FIG. 20 demonstrates that the albumin-PTEN-L fusions disclosed herein rapidly deliver functional PTEN tumor suppressor in the interior of cancer cells, leading to favorable regulation of pharmacodynamic markers, but also to cancer cell death by apoptosis, the latter being the most important property of a functional tumor suppressor. Thus, the present invention has solved the problem of inability of the PTEN tumor suppressor protein to transduce the cancer cell membrane, by providing manufacturable cell-penetrating albumin-PTEN fusions with intact tumor suppressor function.

In other experiments, because it was originally shown that exogenous PTEN-L can induce CASP3/7 activation within a tumor nodule, leading to the reduction of the volume of the tumor nodule in an animal bearing a human cancer xenograft (Hopkins et al, 2013: PMID: 23744781), and given that the Applicant has determined that the albumin-PTEN fusions disclosed herein also activate CASP3/7 to mediate cancer cell death, experiments are performed to show that when administered as a once-daily intravenous monotherapy into mice with PC3 human prostate, 4T1-Luc mouse or MDAMB468 human triple negative breast cancer xenografts, the albumin-PTEN fusions also reduce the volume of the tumor nodules in the mice, in a dose-responsive way over the standard course of 5 weeks.

In some experiments, the manufacturable cell penetrating albumin-PTEN fusion that leads to cancer cell death that is associated with favorable regulation of pharmacodynamic markers in a subject is selected from PR402 (SEQ ID NO:28; cDNA SEQ ID NO:68), PR405 (SEQ ID NO:129; cDNA SEQ ID NO:157), PR407 (SEQ ID NO:131; cDNA SEQ ID NO:159), PR408 (SEQ ID NO:132; cDNA SEQ ID NO:160) or a deletion, point mutant, analog or variant of each thereof.

In other embodiments, the manufacturable cell penetrating albumin-PTEN fusion that leads to cancer cell death that is associated with favorable regulation of pharmacodynamic markers in a subject is selected from PR6 (SEQ ID NO:18; cDNA SEQ ID NO:58), PR61 (SEQ ID NO:19; cDNA SEQ ID NO:59), PR32 (SEQ ID NO:24; cDNA SEQ ID NO:64), PR33 (SEQ ID NO:25; cDNA SEQ ID NO:65), PR34 (SEQ ID NO:50; cDNA SEQ ID NO:136), PR66 (SEQ ID NO:126; cDNA SEQ ID NO:154), PR67 (SEQ ID NO:127;

cDNA SEQ ID NO:155), PR68 (SEQ ID NO:128; cDNA SEQ ID NO:156) or a deletion, point mutant, analog or variant of each thereof.

In other embodiments, the manufacturable albumin-PTEN fusion that circulates in the blood of a subject, when injected into the subject, penetrates cancer cells in an intact form, leading to cancer cell death associated with favorable regulation of pharmacodynamic markers in the subject.

In other embodiments, the manufacturable albumin-PTEN fusion that circulates in the blood of a subject when injected into the subject, is degraded into a cell penetrating PTEN protein, following cleavage of the fusion by a cancer-associated protease, wherein the so released cell penetration-capable PTEN protein enters cancer cells, leading to their death associated with favorable regulation of pharmacodynamic markers in the subject.

In other experiments, the manufacturable albumin-PTEN fusion that circulates in the blood of a subject when injected into the subject, is degraded into a cell penetrating PTEN protein, following cleavage of the fusion by a cancer-associated protease. The so released cell penetration-capable PTEN protein enters cancer cells, leading to their death associated with quantitative measurement of tumor imaging markers in the subject. The pre(clinical) efficacy of the subject to the albumin-PTEN fusion is directly correlated with the imaging biomarker levels in the same cancer and at the same time.

Example 6. Development Scouting of Analytical Methods to Measure PTEN-Albumin Fusion Drug PK Levels in Rodent, Simian and Human Plasma Because PTEN-L and albumin exist in all mammals, rats and cynomolgus monkeys are relevant species for IND-enabling GLP toxicology of the PTEN albumin fusions. However, in view of the saturating amounts and high conservation of circulating albumin in mammalian plasma, antibody-based pharmacokinetic ("PK") bioanalytical methods, such as sandwich ELISA, must be designed based on capturing plasma PTEN rather than albumin. Accordingly, assuming that total PTEN-L levels of subject plasma are relatively low, a PR402-like protein drug PK could be measured using an anti-LUD Ab (e.g. 3A4.1) and one of the four available C-terminal pan-PTEN Abs (FIG. 6B) for analyte capture and detection, respectively. Such an ELISA measures total intact PTEN-L tumor suppressor circulating in rat, simian and human plasma, following injection of a PR402-like protein in a subject. By extension, a 3A4.1/F-10 (valid for rat, simian, human PK) or a 3A4.1/AL-01 (valid for human PK only) sandwich ELISA measures total intact pro-drug PK levels in the PR402 (SEQ ID NO:28; cDNA SEQ ID NO:68), PR405 (SEQ ID NO:129; cDNA SEQ ID NO:157), PR406 (SEQ ID NO:130; cDNA SEQ ID NO:158), PR407 (SEQ ID NO:131; cDNA SEQ ID NO:159) and PR408 (SEQ ID NO:132; cDNA SEQ ID NO:160). setting, prior to release of mature PTEN-L from the fusion at the cancer site of the corresponding species (see FIG. 6B for Ab specificity). In both designs, the focus would be on the measurement of PTEN PK, whereby albumin is considered to play the rather passive role of just providing for the release of active, cell-penetrating PTEN tumor suppressor. Because all three PK assays mentioned above require the same anti-LUD capture Ab, the Applicant first determined whether the commercially available 3A4.1 Ab is fit for bioanalytical PK method development of PR402-like drugs.

To that end, 50 µl of freshly reconstituted IgG capture beads (Dynabeads BioRad catalog #161-4013) were washed 3× in (PBS+0.1% Tween-20) and mixed with 10 of 3A4.1 Ab (Sigma) for 10 min at room temperature (RT) under gentle shaking. Separately, pooled gender total K3-EDTA Sprague Dawley rat plasma (BioIVT, catalog #RAT00PLK3PNN) was diluted 7× with (PBS+0.1% Tween-20) to a final concentration of 16.8 mg/ml and then spiked with either buffer or increasing amounts of semi-pure PR402 (manufactured according to Example 3). The spiked plasma solution was then mixed with the antibody-bead solution in a final reaction volume of 2 ml (final dilution of 3A4.1 mAb was 1:200) and incubated for 1 h at RT under gentle shaking. The beads containing the 3A4.1-PR402 immunoprecipitated complexes were spun and unbound material in the supernatant (i.e., the flowthrough) was collected in a separate tube. The beads were further washed 3× in (PBS+0.1% Tween-20) and finally eluted in 4× Laemmli buffer by heating in the presence of DTT for 10 min at 70° C. The supernatants containing the 3A4.1 immunoprecipitates were loaded on SDS-PAGE and the gel was blotted with the A2B1 anti-PTEN Ab conjugated with IRP.

Figure 21A:
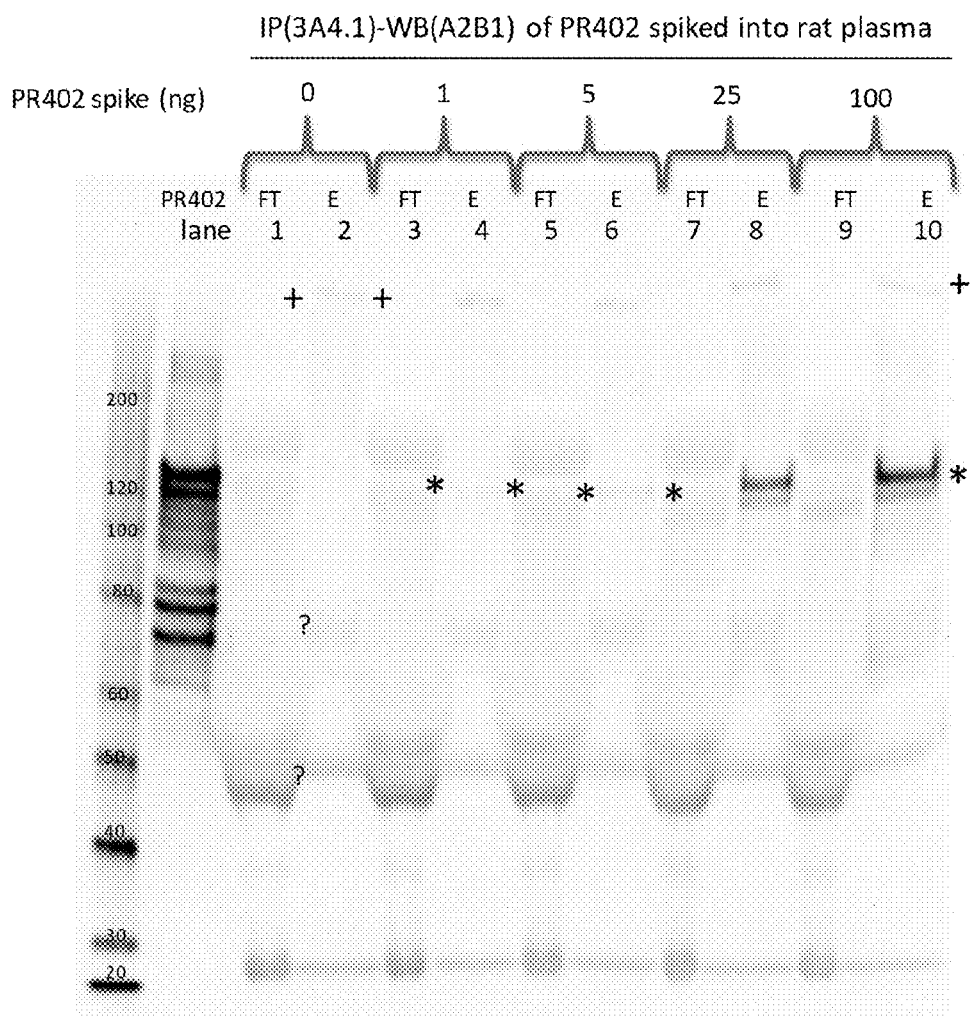
FIGS. 21A to 21F show PK method development scouting for PR402 and PR61. IP-WB of increasing amounts of (0-100 ng) IMAC-purified PR402 spiked into either rat plasma (FIG. 21A), simian plasma (FIG. 21B) or homogenized rat organ extracts (FIGS. 21C-21D) using the 3A4.1/A2B1 mAb combination. PR402 (130 KDa) is denoted by stars, whereas contaminants are denoted by crosses and albumin by question marks, respectively. The second lane from the left (A, B) or the PR402 lane (C) is a WB of the starting material by A2B1 showing the presence of PR402 degradation products in the input which are not recognized by the 3A4.1 antibody. About 16 mg/ml total matrix protein was contained in all IPs except for breast extract which was at 6 mg/ml.

FIG. 21A shows that all flowthroughs (odd lanes) contain fuzzy smears of highly concentrated proteins in the 45-70 KDa area (question marks), which most likely correspond to rat albumin (RSA). The unspoked control (lane 2) shows that while the 3A4.1 mAb recognizes one faint band at 300 KDa (even lanes, crosses), the eluates are otherwise pretty clean, suggesting that this mAb is quite specific for PR402 and there's little interference by the rat plasma matrix. Less than 5 ng, whereas most likely even just 1 ng of spiked PR402 can be immunoprecipitated by 3A4.1 (FIG. 21A, lanes 6 and 4; stars) under these conditions, suggesting that the 3A4.1 mAb is also quite sensitive in the crude rat plasma matrix.

Figure 21B:
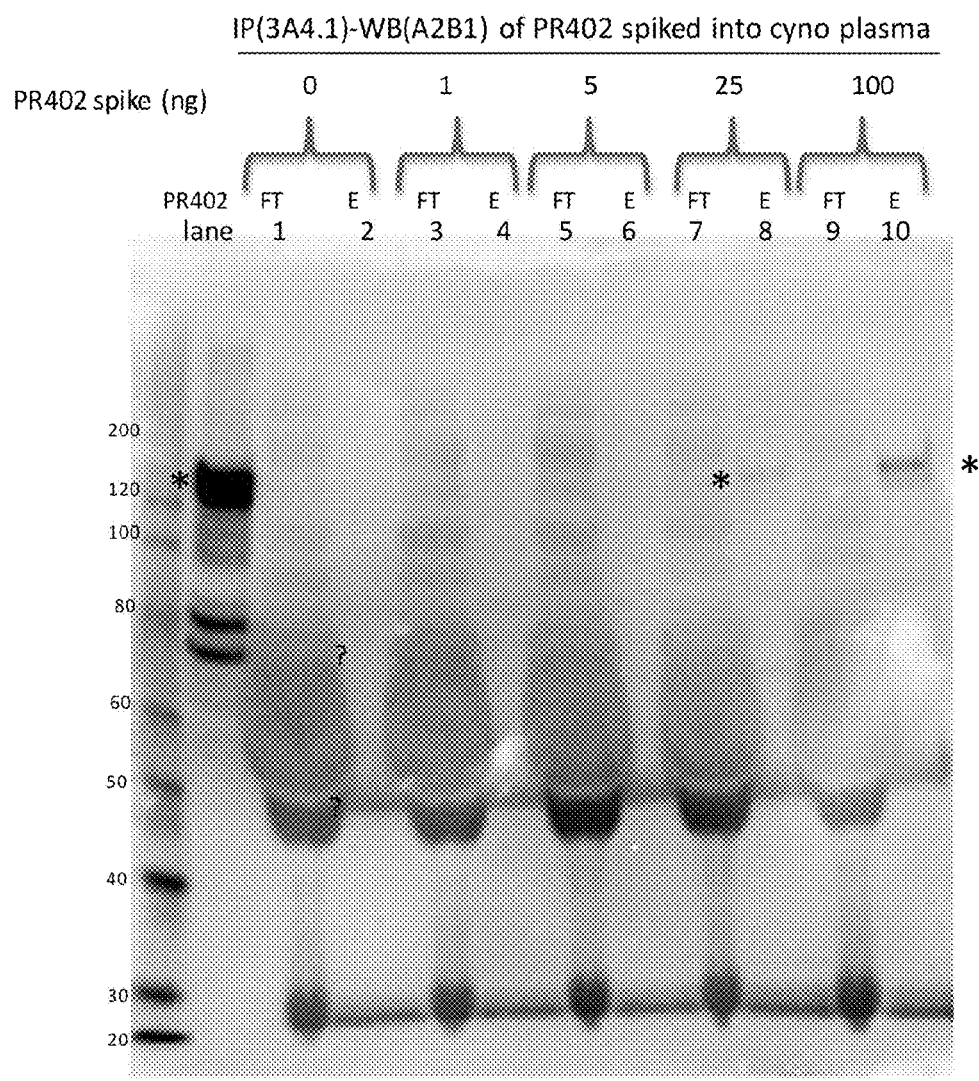

The above experiment was repeated using pooled gender total K3-EDTA Cynomolgous monkey plasma (BioIVT, catalog #NHP01PLK3PNN; FIG. 21B). Antibody specificity appears to be very high in this matrix, given that is the 300 KDa contaminant is now absent from the IPs, whereas the fuzzy migration in the 45 KDa area may again be an artifact of simian albumin (SSA) overload in the flowthrough. In contrast, analyte sensitivity is lower in monkey plasma, as the 5 ng PR402 spike is not detectable anymore. Nevertheless, the results altogether collectively suggest that the anti-LUD 3A4.1 is suitable as a capture Ab in the development of an ELISA bioanalytical method to detect PR402-like drugs in the plasma of rat and cynomolgus monkey.

Figure 21C:
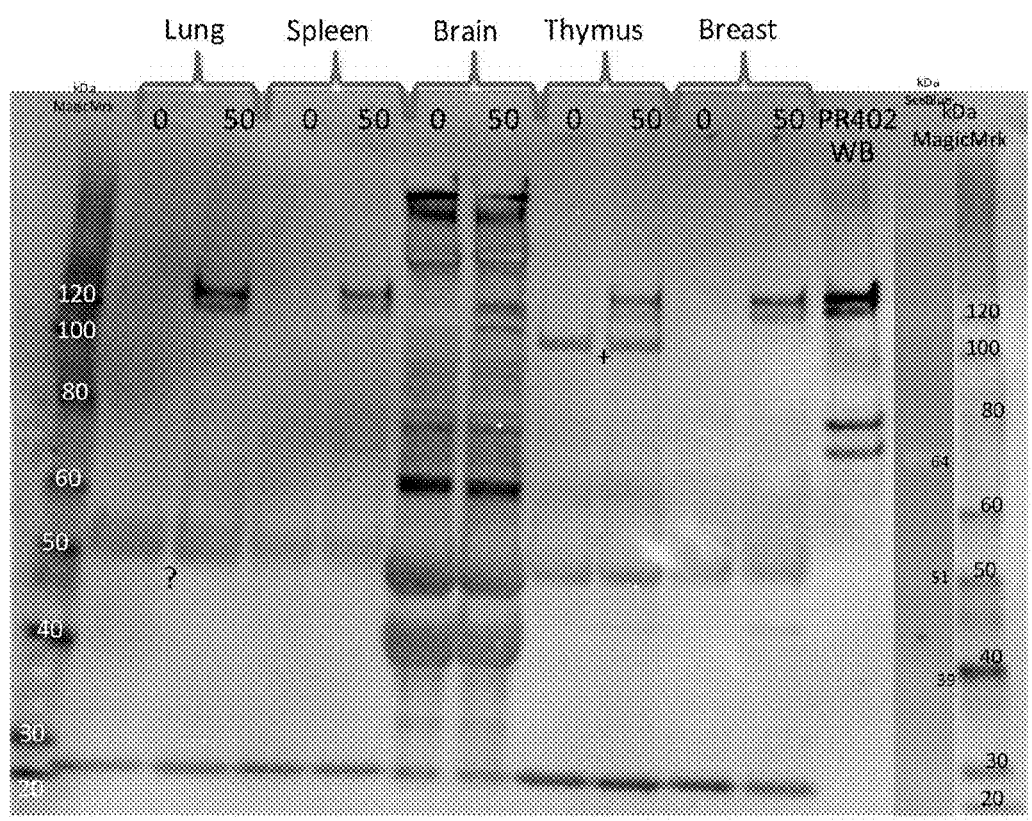
Figure 21D:
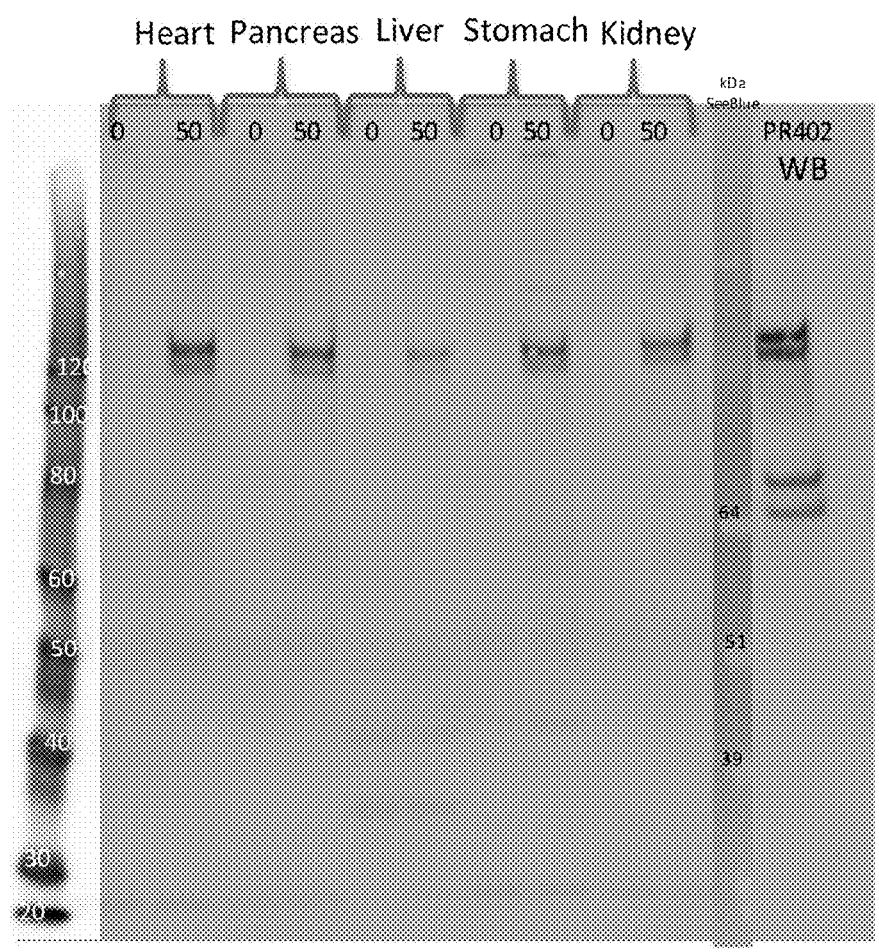

Given the observed high accuracy of the 3A4.1 mAb in rat and cyno plasma, the Applicant asked if rat organ extracts might also be amenable to the above PK ELISA. To that end, an aged female rat was terminated and its organs collected and homogenized by Teflon in (50 mM Tris pH7.4, 150 mM NaCl, 5 mM EDTA, 1% v/v NP-40, 0.25% w/v deoxycholic acid, 0.1% w/v SDS+cOmplete protease inhibitors). 15 mg/ml of clarified organ homogenates (except for breast: 6 mg/ml) were then spiked with buffer or 50 ng of PR402 and treated as above. FIGS. 21C-21D show that the 3A4.1 mAb IPs are still quite clean, with only one non-specific band appearing at around 50-60 KDa across most organs, except for thymus and brain which contribute an additional strong, seemingly specific band of >100KDa and a very complicated band pattern, respectively. Hence, an 3A4.1-based ELISA bioanalytical method to detect PR402-like drugs could be useful as a surrogate method to determine PR402 biodistribution in most rat organ matrices but brain and thymus.

Figure 21E:
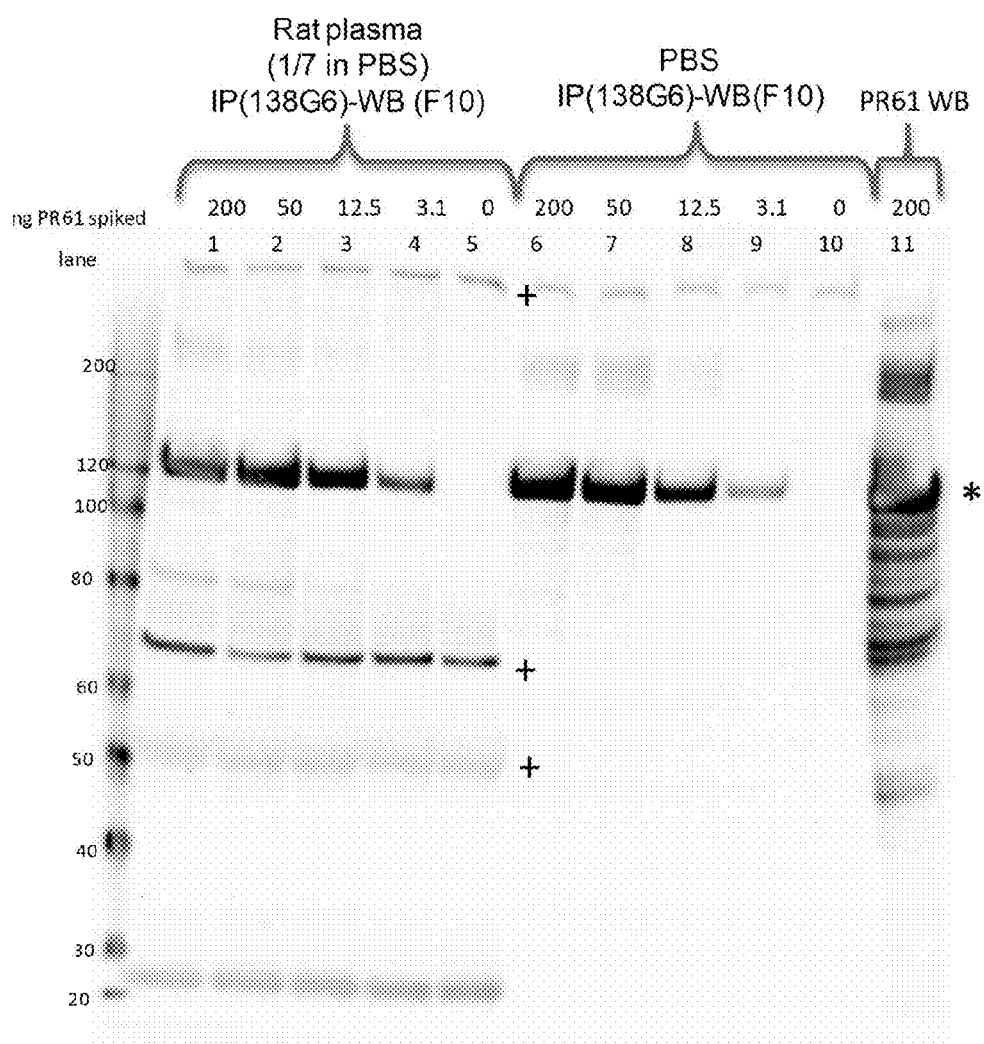

The Applicant then determined whether a C'terminal PTEN mAb (IP)/F-10 (WB) Ab combination is suitable to measure total intact PR61 (SEQ ID NO:19; cDNA SEQ ID NO:59) levels circulating in the plasma of a subject. As shown in FIG. 6B and determined experimentally in detail by Pulido et al, 2019 (PMID: 31501265), 138G6, SP218 and 17A.1 Abs bind the last amino acids of PTEN-S. Hence, by extension, they should also bind PR61-line proteins. Indeed, when varying quantities of PR61 contained in a crude CHO-3E7 supernatant were spiked into PBS or rat plasma and then subjected to IP-WB with a 138G6/F-10 antibody combination, dose responsive capture of PR61 by 138G6 could be demonstrated (FIG. 21E, lanes 1-10; 120 KDa; stars). However, 138G6 quite specifically captured a 70KDa and a 50KDa protein from rat plasma as well, whereas neither of the two proteins could be immunoprecipitated from PBS spiked with PR61 (lane 5, crosses vs. lanes 10 and 6), thereby demonstrating the 70KDa and 50KDa activities were actually rat proteins and not CHO-3E7 host cell contaminants. Suprisingly, when the experiment was repeated using whole serum (diluted 20x in PBS) from a stage IV lung cancer patient (subject #2678246;ProMedDx, Norton, MA) using either SP218 or 17A.1 as the capture antibodies in the IP, specific capture of PR61 by both antibodies could be demonstrated as well, yet again, both SP218 and 17A.1 co-precipitated both the 50 KDa and the 70 KDa protein (FIG. 21F, lane 1 vs. 3 and 5 vs. 7 and data not shown for 17A.1). Thus, two PTEN-like proteins existing in rat plasma and the serum of a cancer patient cross-react with all available C-terminal mAbs that could measure intact PTEN-S, strongly limiting the accuracy of such an ELISA-based PK method for PR61-like proteins.

Difficulty of measuring the PK levels of a recombinant human protein that is exogenously dosed into a subject because of interference by the same protein present in the host is a known problem in the art. Such issues can be resolved by combining an antibody-based analyte capture with protease digestion, liquid chromatography separation and Mass Spectrometry of the resulting digested immune complexes. This technique, referred to as MSIA (Mass Spec Immune Assay) could be relevant for PK measurement of PR61-like drugs. Inspection of the HSA, SSA and RSA sequences (SEQ ID NO:13, 91 and 90), indicates that the Asp-N endopeptidase, which cleaves specifically bonds with Asp in position P1' could be relevant for the development of this MSIA. Accordingly, the cleavage of the last Asp residue on albumin, which is D562, D562 and D565 would release 23aa, 22aa and 21aa-long peptides by HSA, RSA and MSA, respectively. Downstream of albumin and into the PTEN-S protein, the first Asp-N cleavage is predicted to be on D19. Hence, Asp N-based MSIA for a PR61-like protein would release unique signature peptides of 42aa, 41aa and 40aa, respectively (excluding of course the presence of a linker between the two domains, in which case the signature peptide length would increase by the size of the linker or the Asp-degradate thereof). As these signature peptides would span the albumin-PTEN junction, they would be unique and hence enable the development of an accurate PK method.

Figure 21F:
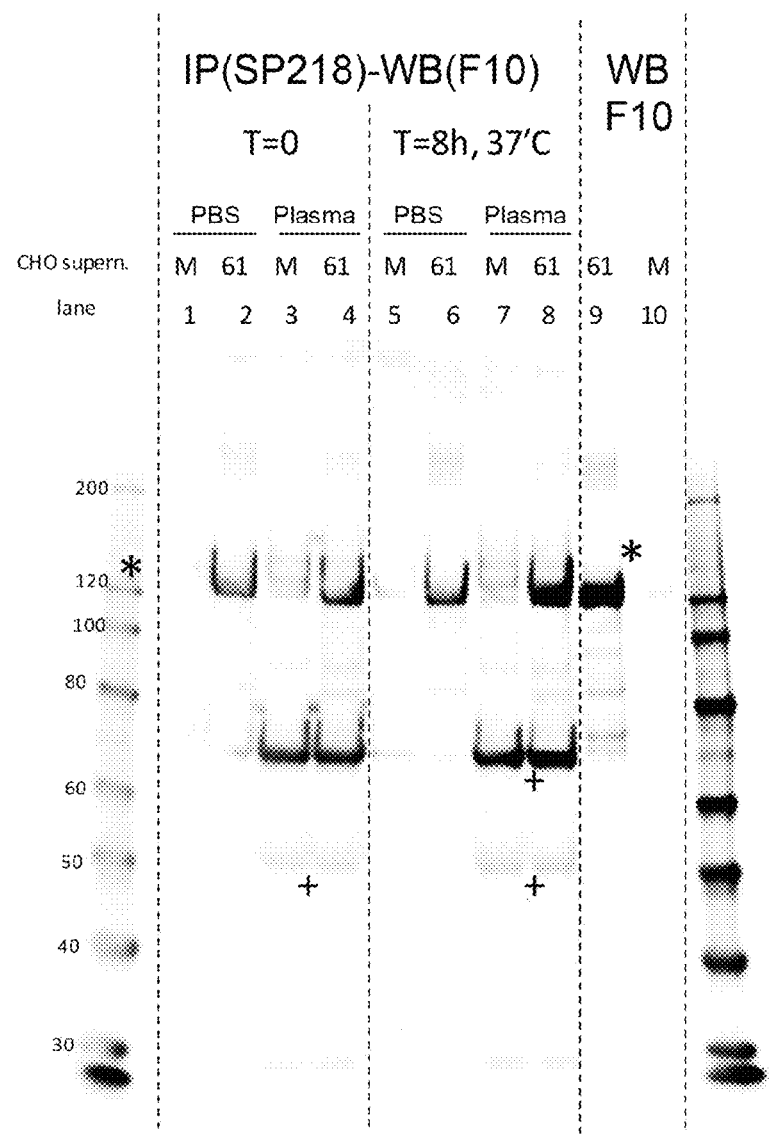

In another aspect, the experiment of FIG. 21F also demonstrates that PR61(SEQ ID NO:19; cDNA SEQ ID NO:59) contained in a crude source like the CHO-3E7 supernatant (which is rich in cell debris and proteases released therefrom) is nevertheless very stable upon prolonged incubation (8h) in either PBS (physicochemical stability) or cancer serum (resistance to proteases released from cell debris) (FIG. 21F, lanes 2 vs. 6 and 4 vs. 8). This bodes well with the excellent stability of PR402 (SEQ ID NO:28; cDNA SEQ ID NO:68), and other such fusions including but not limited to PR405 (SEQ ID NO:129; cDNA SEQ ID NO:157), PR406 (SEQ ID NO:130; cDNA SEQ ID NO:158), PR407 (SEQ ID NO:131; cDNA SEQ ID NO:159) and PR408 (SEQ ID NO:132; cDNA SEQ ID NO:160), during an overnight incubation with active proteases in vitro (FIG. 15).This stability is particularly relevant for the developability of the albumin-PTEN fusions, as discussed further below.

In summary, following extensive characterization of the major expression systems, vectors and host cells, a number of "permissive" novel albumin-PTEN fusion, polynucleotides (for example cDNAs) are disclosed herein that are expressed and/or can be manufactured in high amounts, while retaining PTEN tumor suppressor function. The cDNAs and proteins of the present disclosure are therefore suitable for both gene and protein therapy of a subject in need thereof.

Embodiments of the Invention

Embodiment 1

A fusion protein comprising consecutive amino acid sequences of human serum albumin (HSA) and the human Phosphatase and Tensin Homolog (PTEN or PTEN-L) tumor suppressor, wherein the HSA is upstream or downstream to the PTEN or PTEN-L.

Embodiment 2

The fusion protein of embodiment 1, wherein HSA comprises the amino acid sequence of SEQ ID NO:12, 13, 90, 91, 92 or 163 or an equivalent of each.

Embodiment 3

The fusion protein of embodiment 1 or 2, wherein PTEN-L comprises the amino acid sequence of SEQ ID NO:1, 2, 3, 6, 7, 8, 88, 89 or 162 or an equivalent of each.

Embodiment 4

A fusion protein that comprises an amino acid sequence selected from the group of SEQ ID NOs:28, 19, 18, 129, 131, 25 or 50 or a fragment, analogue, variant or equivalent of each.

Embodiment 5

A fusion protein that comprises an amino acid sequence encoded by an engineered polynucleotide sequence selected from the group of: SEQ ID NOs:68, 59, 58, 157, 159, 65 or 136, or a fragment thereof, or a sequence at least 90% identical thereto which encodes the same amino acid sequence as SEQ ID NOs: 68, 59, 58, 157, 159, 65, or 136 respectively.

Embodiment 6

A fusion protein comprising any one of the amino acid sequence of SEQ ID NOs:14-30, 34-37, 49-50, 109-132, or a fragment, analogue, variant or equivalent of each, or a mutant of each further comprising one or more mutations selected a position equivalent to any one or more of the following: S65, S85, S89, S91, S94, S111, S115, S117, S129, S134, T140, S161, S163, S164 and S168 of SEQ ID NO:1 and/or S170, N292, S355, S360, S366 and S370 of SEQ ID NO:2, optionally to an aspartate or a glutamate, optionally wherein the protein is glycosylated, further optionally wherein the protein is O-glycosylated on one or more of the positions other than the one equivalent to N292 of SEQ ID NO:2, and further optionally wherein the amino acid residue equivalent to N292 of SEQ ID NO:2 is N-glycosylated.

Embodiment 7

A fusion protein comprising an amino acid sequence encoded by an engineered polynucleotide sequence selected from the group of: SEQ ID NOs:54-70, 74-77, 135-160 or a fragment thereof, or a sequence at least 90% identical thereto which encodes the same amino acid sequence as SEQ ID NOs:54-70, 74-77, 135-160, respectively.

Embodiment 8

A fusion protein comprising a consecutive amino acid sequences of a serum albumin and a Phosphatase and Tensin Homolog (PTEN), and optionally wherein the PTEN is selected from the group of: human PTEN, simian PTEN, rat PTEN, or murine PTEN.

Embodiment 9

The fusion protein of embodiment 8, wherein the amino acid sequence of the serum albumin is conjugated directly or indirectly to the N-terminal of the PTEN.

Embodiment 10

The fusion protein of embodiment 8, wherein the amino acid sequence of the serum albumin is conjugated directly or indirectly to the C-terminal of the PTEN.

Embodiment 11

The fusion protein of any one of embodiments 8 to 10, wherein the serum albumin is selected from the group of: a human serum albumin (HSA), a simian serum albumin (SSA), a rat serum albumin (RSA), or a mouse serum albumin (MSA), or a fragment, analogue, variant, mutant, isoform or equivalent of each, optionally wherein the serum albumin comprises an albumin domain I equivalent to amino acids 1-197 of SEQ ID NO:13, optionally wherein the serum albumin comprises domains I and II of an albumin equivalent to amino acids 1-395 of SEQ ID NO:13, optionally wherein the albumin lacks an albumin domain III equivalent to amino acids 382-585 of SEQ ID NO:13, optionally wherein the albumin lacks an albumin domain II equivalent to amino acids 198-381 of SEQ ID NO:13, optionally wherein the albumin lacks an albumin domain II and III equivalent to amino acids 198-585 of SEQ ID NO:13, optionally wherein the albumin lacks the first 34 or 62 amino acids of a mature HSA or an equivalent thereof, and further optionally wherein the albumin comprises an amino acid sequence of amino acids 35-385 or 63-585 of SEQ ID NO:13 or an equivalent thereof.

Embodiment 12

The fusion protein of any one of embodiments 8 to 11, wherein the serum albumin is a pre-protein which comprises a signal peptide, or a mature serum albumin which lacks a signal peptide, optionally wherein the serum albumin comprises a mutation at a position equivalent to amino acid 58 or SEQ ID NO:12 or amino acid 34 of SEQ ID NO:13, optionally from Cysteine to Serine, or an equivalent of each that retains the mutation at amino acid 34 of SEQ ID NO:13, optionally wherein the serum albumin comprises an amino acid conjugated with a molecule at a position equivalent to amino acid 34 of SEQ ID NO:13, and wherein the molecule is a small molecule, a cytotoxic molecule, a linker, a pH-sensitive linker, and/or a thiol linker.

Embodiment 13

The fusion protein of any one of embodiments 8 to 12, wherein the serum albumin comprises an amino acid sequence selected from the group of: SEQ ID NOs:12-13, 90-93 and 163, or an analogue, variant, mutant, isoform or equivalent of any one of SEQ ID NOs:12-13, 90-93 and 163 that has the same or similar activity as SEQ ID NOs:12, 13, 90-93, or 163, respectively.

Embodiment 14

The fusion protein of any one of embodiments 8 to 13, wherein the serum albumin comprises an amino acid sequence encoded by an engineered polynucleotide sequence selected from the group of: SEQ ID NO:176-179, or a sequence at least 90% identical thereto which encodes the same amino acid sequence as encoded by SEQ ID NO:176-179.

Embodiment 15

The fusion protein of any one of embodiments 8 to 14, further comprising a signal peptide.

Embodiment 16

The fusion protein of embodiment 15, wherein the signal peptide is at the N-terminal of the fusion protein for secretion.

Embodiment 17

The fusion protein of embodiment 15 or 16, wherein the signal peptide is selected from the group of: an HSA signal peptide, an SSA signal peptide, an RSA signal peptide, an MSA signal peptide, a signal peptide of murine α2-macroglobulin, a murine fibrinogen signal peptide, a murine α1-antitrypsin signal peptide, a murine IgGκ chain signal peptide, a human IgG heavy chain signal peptide, a human CD33 signal peptide, or an artificial signal peptide, optionally wherein the signal peptide comprises an amino acid sequence selected from the group of SEQ ID NOs:93-105, and preferably wherein the signal peptide is an HSA signal peptide.

Embodiment 18

The fusion protein of any one of embodiments 15 to 17, wherein the signal peptide is encoded by an engineered polynucleotide sequence selected from the group of: SEQ ID NO:180-192, or a sequence at least 90% identical thereto which encodes the same amino acid sequence as SEQ ID NO:93-105, respectively.

Embodiment 19

The fusion protein of any one of embodiments 8 to 18, wherein the PTEN is a PTEN-Long (PTEN-L), or a fragment, analogue, variant, mutant, or equivalent thereof, optionally wherein the PTEN-L is a human PTEN-L having an amino acid sequence of SEQ ID NO:3, and/or optionally wherein the PTEN-L is a human PTEN-L encoded by an engineered polynucleotide sequence of SEQ ID NO:171 or nucleotide (nt) 64-nt 1728 of SEQ ID NO:171, or a sequence at least 90% identical thereto which encodes the same amino acid sequence as encoded by SEQ ID NO:171 or nucleotide (nt) 64-nt 1728 of SEQ ID NO:171.

Embodiment 20

The fusion protein of any one of embodiments 8 to 18, wherein the PTEN is a PTEN-M isoform, or a fragment, analogue, variant, mutant, or equivalent thereof, optionally wherein the PTEN-M is a human PTEN-M having an amino acid sequence of SEQ ID NO:6, and/or optionally wherein the PTEN-M is a human PTEN-M encoded by an engineered polynucleotide sequence of SEQ ID NO:198, or a sequence at least 90% identical thereto which encodes the same amino acid sequence as SEQ ID NO:6.

Embodiment 21

The fusion protein of any one of embodiments 8 to 18, wherein the PTEN is a PTEN-N isoform, or a fragment, analogue, variant, mutant, or equivalent thereof, optionally wherein the PTEN-N is a human PTEN-N having an amino acid sequence of SEQ ID NO:7, and/or optionally wherein the PTEN-N is a human PTEN-N encoded by an engineered polynucleotide sequence of SEQ ID NO:199, or a sequence at least 90% identical thereto which encodes the same amino acid sequence as SEQ ID NO:7.

Embodiment 22

The fusion protein of any one of embodiments 8 to 18, wherein the PTEN is a PTEN-O isoform, or a fragment, analogue, variant, mutant, or equivalent thereof, optionally wherein the PTEN-O is a human PTEN-O having an amino acid sequence of SEQ ID NO:8, and/or optionally wherein the PTEN-O is a human PTEN-O encoded by an engineered polynucleotide sequence of SEQ ID NO:200, or a sequence at least 90% identical thereto which encodes the same amino acid sequence as SEQ ID NO:8.

Embodiment 23

The fusion protein of any one of embodiments 8 to 18, wherein the PTEN comprises any one or more of the following:
  (i) a mature human PTEN-L Unique Domain (LUD), or a fragment, analogue, variant, mutant, or equivalent thereof, optionally wherein the LUD comprises an amino acid sequence of SEQ ID NO:5, further optionally wherein the LUD comprises an amino acid sequence encoded by the engineered polynucleotide sequence of SEQ ID NO:193, or a sequence at least 90% identical thereto which encodes the same amino acid sequence as SEQ ID NO:5, optionally wherein the LUD is glycosylated, further optionally wherein one or more of the serine (S) and/or threonine (T) residues of the LUD is O-glycosylated;
  (ii) a human PTEN-M Unique Domain (MUD), or a fragment, analogue, variant, mutant, or equivalent thereof, optionally wherein the MUD comprises an amino acid sequence of SEQ ID NO:9, and/or further optionally wherein the MUD comprises an amino acid sequence encoded by the engineered polynucleotide sequence of SEQ ID NO:194, or a sequence at least 90% identical thereto which encodes the same amino acid sequence as SEQ ID NO:9, optionally wherein the MUD is O-glycosylated;
  (iii) a human PTEN-N Unique Domain (NUD), or a fragment, analogue, variant, mutant, or equivalent thereof, optionally wherein the NUD comprises an amino acid sequence of SEQ ID NO:10, and/or further optionally wherein the NUD comprises an amino acid sequence encoded by the engineered polynucleotide sequence of SEQ ID NO:195, or a sequence at least 90% identical thereto which encodes the same amino acid sequence as SEQ ID NO:10, optionally wherein the NUD is glycosylated, further optionally wherein one or more of the serine (S) and/or threonine (T) residues of the NUD is O-glycosylated;
  (iv) a human PTEN-O Unique Domain (OUD), or a fragment, analogue, variant, mutant, or equivalent thereof, optionally wherein the OUD comprises an amino acid sequence of SEQ ID NO:11, and/or further optionally wherein the OUD comprises an amino acid sequence encoded by the engineered polynucleotide sequence of SEQ ID NO:196, or a sequence at least 90% identical thereto which encodes the same amino acid sequence as SEQ ID NO:11, optionally wherein the OUD is glycosylated, further optionally wherein one or more of the serine (S) and/or threonine (T) residues of the OUD is O-glycosylated;
  (v) a minimal cell-penetration domain (MCPD) comprising an amino acid sequence of 6×Arg (SEQ ID NO:39), and optionally wherein the fusion protein comprises a cleavable linker between the PTEN and the albumin;
  (vi) a membrane-binding domain (MBD), optionally wherein the MBD comprises an amino acid sequence of SEQ ID NO:40;
  (vii) a minimal PTEN-S, or a fragment, analogue, variant, mutant, or equivalent thereof, optionally wherein the minimal PTEN-S comprises an amino acid sequence of SEQ ID NO:162, and/or further optionally wherein the minimal PTEN-S comprises an amino acid sequence encoded by the engineered polynucleotide sequence of SEQ ID NO:197, or a sequence at least 90% identical thereto which encodes the same amino acid sequence as SEQ ID NO:162; and
  (viii) a PTEN-S, or a fragment, analogue, variant, mutant, or equivalent thereof, optionally wherein the PTEN-S comprises an amino acid sequence of SEQ ID NO:2, and/or further optionally wherein the PTEN-S comprises an amino acid sequence encoded by the engineered polynucleotide sequence of SEQ ID NO:172, or a sequence at least 90% identical thereto which encodes the same amino acid sequence as SEQ ID NO:2.

Embodiment 24

The fusion protein of any one of embodiments 8 to 23, wherein the PTEN comprises a minimal PTEN-S, or a fragment, analogue, variant, mutant, or equivalent thereof, optionally wherein the minimal PTEN-S comprises an amino acid sequence of SEQ ID NO:162, and/or further optionally wherein the minimal PTEN-S comprises an amino acid sequence encoded by the engineered polynucleotide sequence selected SEQ ID NO:197, or a sequence at least 90% identical thereto which encodes the same amino acid sequence as SEQ ID NO:162.

Embodiment 25

The fusion protein of any one of embodiments 8 to 24, wherein the PTEN comprises a PTEN-S, or a fragment, analogue, variant, mutant, or equivalent thereof.

Embodiment 26

The fusion protein of any one of embodiments 8 to 25, wherein the PTEN is a PTEN-S, or a fragment, analogue, variant, mutant, or equivalent thereof, and optionally wherein the fusion protein lack a cleavable linker between the PTEN-S and the albumin.

Embodiment 27

The fusion protein of any one of embodiments 8 to 26, wherein the PTEN is in its mature form which lacks a single peptide, or is a pre-protein.

Embodiment 28

The fusion protein of any one of embodiments 8-19, 23-25 and 27, wherein the PTEN comprises an amino acid sequence selected from the group of: SEQ ID NO:1 or 3 or 89, or a fragment, analogue, variant, mutant, or equivalent thereof.

Embodiment 29

The fusion protein of any one of embodiments 8-19, 23-25, 27 and 28, wherein the PTEN comprises an amino acid sequence encoded by an engineered polynucleotide sequence selected from the group of: SEQ ID NO:171, nucleotide (nt) 64-nt 1728 of SEQ ID NO:171, or SEQ ID NO:167, or a fragment thereof, or a sequence at least 90% identical thereto which encodes the same amino acid sequence as the amino acid sequence encoded by SEQ ID NO:171, nt 64-nt 1728 of SEQ ID NO:171, or SEQ ID NO:167, respectively.

Embodiment 30

The fusion protein of any one of embodiments 8-18, 20, 23-25 and 27, wherein the PTEN comprises an amino acid sequence of SEQ ID NO:6 or 201, or a fragment, analogue, variant, mutant, or equivalent of SEQ ID NO:6 or 201.

Embodiment 31

The fusion protein of any one of embodiments 8-18, 20, 23-25, 27 and 30, wherein the PTEN comprises an amino acid sequence encoded by an engineered polynucleotide sequence selected from the group of: SEQ ID NO:198 or 204, or a fragment thereof, or a sequence at least 90% identical thereto which encodes the same amino acid sequence as the amino acid sequence encoded by SEQ ID NO:198 or 204, respectively.

Embodiment 32

The fusion protein of any one of embodiments 8-18, 21, 23-25 and 27, wherein the PTEN comprises an amino acid sequence of SEQ ID NO:7 or 202, or a fragment, analogue, variant, mutant, or equivalent of SEQ ID NO:7 or 202.

Embodiment 33

The fusion protein of any one of embodiments 8-18, 21, 23-25, 27 and 32, wherein the PTEN comprises an amino acid sequence encoded by an engineered polynucleotide sequence selected from the group of SEQ ID NO:199, or 205, or a fragment thereof, or a sequence at least 90% identical thereto which encodes the same amino acid sequence as the amino acid sequence encoded by SEQ ID NO:199, or 205, respectively.

Embodiment 34

The fusion protein of any one of embodiments 8-18, 22-25 and 27, wherein the PTEN comprises an amino acid sequence of SEQ ID NO:8 or 203, or a fragment, analogue, variant, mutant, or equivalent of SEQ ID NO:8 or 203.

Embodiment 35

The fusion protein of any one of embodiments 8-18, 22-25, 27 and 34, wherein the PTEN comprises an amino acid sequence encoded by an engineered polynucleotide sequence selected from the group of: SEQ ID NO:200 or 206, or a fragment thereof, or a sequence at least 90% identical thereto which encodes the same amino acid sequence as the amino acid sequence encoded by SEQ ID NO:200 or 206.

Embodiment 36

The fusion protein of any one of embodiments 8-18 and 23-27, wherein the PTEN comprises an amino acid sequence selected from the group of: SEQ ID NO:2 or 88, or a fragment, analogue, variant, mutant, or equivalent of SEQ ID NO:2 or 88.

Embodiment 37

The fusion protein of any one of embodiments 8-18, 23-27 and 36, wherein the PTEN comprises an amino acid sequence encoded by an engineered polynucleotide sequence selected from the group of: SEQ ID NO:172 or 166, or a fragment thereof, or a sequence at least 90% identical thereto which encodes the same amino acid sequence as the amino acid sequence encoded by SEQ ID NO:172 or 166, respectively.

Embodiment 38

The fusion protein of any one of embodiments 8 to 25 and 27 to 37, further comprising one or more mutations selected a position equivalent to any one or more of the following: S65, S85, S89, S91, S94, S111, S115, S117, S129, S134, T140, S161, S163, S164 and S168 of SEQ ID NO:1 and/or S170, N292, S355, S360, 5366 and S370 of SEQ ID NO:2, optionally to an aspartate or a glutamate.

Embodiment 39

The fusion protein of any one of embodiments 8 to 25 and 27 to 38, where in the PTEN comprises amino acids 174 to 576 of SEQ ID NO:1 and one or more of the following:
(i) amino acids 22-27 of SEQ ID NO:1;

(ii) amino acids 44-59 of SEQ ID NO:1;
(iii) amino acids 43-79 of SEQ ID NO:1;
(iv) amino acids 80-120 of SEQ ID NO:1;
(v) amino acids 121-173 of SEQ ID NO:1; and/or
(vi) amino acids 151-173 of SEQ ID NO:1.

Embodiment 40

The fusion protein of any one of embodiments 8 to 39, further comprising one or more of the following: a first linker between the albumin and the PTEN, a second linker at the C-terminal of the signal peptide and a third linker at the N-terminal of the fusion protein, and optionally wherein one or more of the linkers are cleavable.

Embodiment 41

The fusion protein of embodiment 40, wherein the linker is cleavable by a protease present in a peri-cancerous cell or tissue, optionally wherein the protease is selected from the group of: MMP2, MMP9 or Cathepsin B, and further optionally wherein the linker comprises an amino acid sequence selected from the group of: SEQ ID NOs:48, 164-165 and 106-108.

Embodiment 42

The fusion protein of embodiment 40, wherein the linker and/or the fusion protein is cleavable by an intracellular protease, optionally wherein the protease is a furin or a furin-like protease, or cathepsin B protease, and further optionally wherein the linker comprises an amino acid sequence selected from the group of SEQ ID NO:48 or 106-108, and/or the PTEN comprises a Minimal Cell Penetration Domain (MCPD).

Embodiment 43

The fusion protein of any one of the embodiments 1 to 42, further comprising a purification or detectable marker.

Embodiment 44

The fusion protein of embodiment 43, wherein the marker is one or more of marker(s) selected from the group of: a 6×His tag (SEQ ID NO: 222), a hemagglutinin (HA) tag, a flag tag, or any other epitope tag.

Embodiment 45

The fusion protein of embodiment 43 or 44, wherein one or more markers are at the C-terminal of the fusion protein and/or wherein one or more markers are between the albumin and the PTEN.

Embodiment 46

A fusion protein consisting of an amino acid sequence selected from the group of: SEQ ID NOs:14-30, 34-37, 49-50, 109-132 or a fragment, analogue, variant, mutant, or equivalent of each of SEQ ID NOs:14-30, 34-37, 49-50, 109-132, or a mutant of each further comprising one or more mutations selected a position equivalent to any one or more of the following: S65, S85, S89, S91, S94, S111, S115, S117, S129, S134, T140, S161, S163, S164 and S168 of SEQ ID NO:1 and/or S170, N292, S355, S360, 5366 and S370 of SEQ ID NO:2, optionally to an aspartate or a glutamate, optionally wherein the protein is glycosylated, further optionally wherein one or more of the serine (S) and/or threonine (T) residues of the protein is O-glycosylated, and yet further optionally wherein one or more of asparagine (N) residues of the protein is N-glycosylated.

Embodiment 47

A fusion protein consisting of an amino acid sequence encoded by an engineered polynucleotide sequence selected from the group of: SEQ ID NOs:54-70, 74-77, 135-160 or a fragment thereof, or a sequence at least 90% identical thereto which encodes the same amino acid sequence as SEQ ID NOs: 54-70, 74-77, 135-160 respectively.

Embodiment 48

A fusion protein consisting of an amino acid sequence selected from the group of SEQ ID NOs:14-30, 34-37, 49-50, 109-132, or a fragment, analogue, variant, mutant, or equivalent of each of SEQ ID NOs:14-30, 34-37, 49-50, 109-132, or a mutant of each further comprising one or more mutations selected a position equivalent to any one or more of the following: S65, S85, S89, S91, S94, S111, S115, S117, S129, S134, T140, S161, S163, S164 and S168 of SEQ ID NO:1 and/or S170, N292, S355, S360, S366 and S370 of SEQ ID NO:2, optionally to an aspartate or a glutamate, optionally wherein the protein is glycosylated, further optionally wherein one or more of the serine (S) and/or threonine (T) residues of the protein is O-glycosylated, and yet further optionally wherein one or more of asparagine (N) residues of the protein is N-glycosylated.

Embodiment 49

A fusion protein consisting of an amino acid sequence encoded by an engineered polynucleotide sequence selected from the group of: SEQ ID NOs:54-70, 74-77, 135-160, a fragment thereof, or a sequence at least 90% identical thereto which encodes the same amino acid sequence as SEQ ID NOs:54-70, 74-77, 135-160, respectively.

Embodiment 50

The fusion protein of any one of embodiments 1 to 49, wherein the fusion protein is produced by a process comprising the step of culturing a host cell capable of expressing the fusion protein under conditions suitable for expression of the fusion protein.

Embodiment 51

The fusion protein of embodiment 50, further comprising purifying or isolating the fusion protein optionally from the cell or cell culture medium.

Embodiment 52

The fusion of embodiment 50 or 51, wherein the host cell is prokaryotic cell or a eukaryotic cell, optionally wherein the host cell is selected from the group of a Chinese hamster ovary (CHO) cell, or a HEK293 cell, optionally wherein the CHO cell is a CHO-3E7 cell having an ExPASy accession number of CVCL_JY74, optionally wherein the HEK293 cell is aHEK293-EBNA1-6E having an ExPASy accession number of CVCL_HF20, further optionally wherein the host cell lacks expression of a protease, optionally wherein the protease is an intracellular protease or a protease present in a peri-cancerous cell or tissue, and optionally wherein the protease is selected from the group of furin, MMP2/9 or Cathepsin B, optionally wherein the host cell is a natural furin knock-out (KO) cell, and further optionally wherein the host cell is LoVo cells.

Embodiment 53

A polynucleotide encoding a fusion protein of any one of embodiments 1 to 52, optionally wherein the polynucleotide is selected from the group of a DNA, a messenger RNA, or a hybrid thereof.

Embodiment 54

The polynucleotide of embodiment 53, further comprising regulatory sequences for expression of the polynucleotide in a host cell, and optionally wherein the regulatory sequences are tumor-specific.

Embodiment 55

The polynucleotide of embodiment 54, wherein the regulatory sequence comprises a promoter and/or enhancer element.

Embodiment 56

A vector comprising the polynucleotide of any one of embodiments 53 to 55.

Embodiment 57

The vector of embodiment 56, optionally wherein the vector is an AdV vector or a HSV vector, and further optionally wherein the vector is a viral vector, optionally wherein the vector is selected from the group of: rabies virus, flavivirus, lentivirus, baculovirus, retroviral vectors, adenovirus vectors, adeno-associated virus vectors, herpes simplex virus vectors, alphavirus vectors, Seneca Valley virus, poliovirus, vaccinia virus, reovirus, Coxsackievirus, parvovirus, Newcastle disease virus, vesicular stomatitis virus, measles virus, or infectious tobacco mosaic virus (TMV), and further optionally wherein the vector is suitable for an anti-cancer therapy and/or a gene therapy.

Embodiment 58

The vector of embodiment 56, wherein the vector is a non-viral vector, optionally wherein the vector is selected from the group of: liposomes, cationic lipid, micelles biocompatible polymers, including natural polymers and synthetic polymers; nanoparticles; lipoproteins; polypeptides; polysaccharides; lipopolysaccharides; metal particles; bacteria, bacteriophage, cosmid, plasmid, a yeast artificial chromosome, or fungal vectors, optionally wherein the plasmid is selected from the group of a pSIP609 *L plantarum* expression vector, a *Pichia pastoris* expression vector, or a mammalian expression vector, and further optionally wherein the plasmid comprises a sequence selected from the group of SEQ ID NOs:173-175, and further optionally wherein the vector is suitable for an anti-cancer therapy and/or a gene therapy.

Embodiment 59

A host cell comprising a polynucleotide of any one of embodiments 53 to 55, and/or a vector of any one of embodiments 56 to 58.

Embodiment 60

The host cell of embodiment 59, wherein the host cell is selected from the group of a Chinese hamster ovary (CHO) cell, or a HEK293 cell, optionally wherein the CHO cell is a CHO-3E7 cell having an ExPASy accession number of CVCL_JY74, optionally wherein the HEK293 cell is aHEK293-EBNA1-6E having an ExPASy accession number of CVCL_HF20, further optionally wherein the host cell lacks expression of a protease, optionally wherein the protease is an intracellular protease or a protease present in a peri-cancerous cell or tissue, and optionally wherein the protease is selected from the group of furin, MMP2/9 or Cathepsin B, optionally wherein the host cell is a natural furin knock-out (KO) cell, and further optionally wherein the host cell is LoVo cells.

Embodiment 61

A pharmaceutical composition comprising one or more of the following: a fusion protein according to any one of embodiments 1 to 52, a polynucleotide of any one of embodiments 53 to 55, and/or a vector of any one of embodiments 59 to 60; and at least one pharmaceutically acceptable carrier, and optionally wherein the pharmaceutically acceptable carrier comprises a stabilizer and/or a preservative.

Embodiment 62

The pharmaceutical composition of embodiment 61, wherein the HSA-PTEN-L fusion protein comprises an amino acid sequence having at least 90% sequence identity to the amino acid sequence of SEQ ID NO:19 or SEQ ID NO:28.

Embodiment 63

A pharmaceutical composition comprising HSA-PTEN-L fusion protein that comprises or the amino acid sequence of SEQ ID NO:19 or SEQ ID NO:28 and at least one pharmaceutically acceptable carrier.

Embodiment 64

A pharmaceutical composition comprising an HSA-PTEN-L fusion protein consisting of the amino acid sequence of SEQ ID NO:19 or SEQ ID NO:28, and at least one pharmaceutically acceptable carrier.

Embodiment 65

The pharmaceutical composition of any one of embodiments 61 to 64, wherein the HSA-PTEN-L fusion protein is produced in a CHO cell or a HEK293 cell, optionally wherein the CHO cell is a CHO-3E7 cell having an ExPASy accession number of CVCL_JY74, optionally wherein the HEK293 cell is aHEK293-EBNA1-6E having an ExPASy accession number of CVCL_HF20, further optionally wherein the cell lacks expression of a protease, optionally wherein the protease is an intracellular protease or a protease present in a peri-cancerous cell or tissue, and optionally wherein the protease is selected from the group of furin, MMP2/9 or Cathepsin B, optionally wherein the host cell is a natural furin knock-out (KO) cell, and further optionally wherein the host cell is LoVo cells.

Embodiment 66

The pharmaceutical composition of any one of embodiments 61 to 65, further comprising an additional therapeutic agent.

Embodiment 67

A kit comprising one or more of the following: a fusion protein of any one of embodiments 1 to 52, a polynucleotide of any one of embodiments 53 to 55, a vector of any one of embodiments 56 to 58, or a pharmaceutical composition of any one of embodiments 61 to 66, and optional instructions for use.

Embodiment 68

A method of treating a cancer or tumor, comprising administering an effective amount of one or more of the following: a fusion protein of any one of embodiments 1 to 52, a polynucleotide of any one of embodiments 53 to 55, a vector of any one of embodiments 56 to 58, or a pharmaceutical composition of any one of embodiments 61 to 66, to a subject in need thereof, thereby treating the cancer or tumor.

Embodiment 69

The method of embodiment 68, wherein the subject is suspected of having and/or is diagnosed with a cancer or tumor or a diseases associated with low expression or lacking expression of a PTEN, and/or wherein the subject has a high expression level of a miRNA targeting the 3' of the PTEN tumor suppressor mRNA compared to a control, optionally wherein the control is a biological sample isolated from a subject who is free of any cancer or tumor, optionally wherein the control is any other cancer or tumor, optionally wherein the miRNA is an onco-miR, optionally the onco-miR is one or more of miR-106a, miR-130a, miR-181b-1, miR-21, miR-214, miR-26a-5p, miR-301a, miR-486-5p, mir-1273g-3p, miR-200b, miR-26a, miR-103, miR-106b, miR-106b-93, miR-107, miR-10b, miR-1297, miR-130, mir-130b, miR-142-5p, miR-144, miR-146b, miR-153, miR-155, miR-17, miR-17-5p, miR-181, miR-181a, miR-181c, miR-18a, miR-19, miR-197-3p, miR-19a, miR-19b, miR-200, miR-200a, miR-205, miR-205-5p, miR-20b, miR-218, miR-22, miR-221, miR-222, miR-224, miR-23a, miR-23b-3p, miR-25, mir-29c, miR-301a-3p, miR-32-5p, miR-335, miR-338-3p, miR-374a, miR-410-3p, miR-4299, miR-454, miR-494, miR-543, miR-548, miR-616-3p, miR-7, miR-718, miR-9, miR-92a, miR-92b, miR-93, miR-93-5p, miR-940 or miR-let 7b, optionally wherein the level of the miRNA is detected in a liquid biological sample of the subject, and further optionally wherein the liquid biological sample is selected from the group of blood, serum or plasma.

Embodiment 70

The method of embodiment 68 or 69, wherein the cancer or tumor is a primary or metastatic cancer or tumor; a solid tumor; a gastric cancer, a colorectal cancer, a prostate cancer, a breast cancer, a triple negative breast cancer, an ovarian carcinoma, a renal cell carcinoma, an Ewing sarcoma, a melanoma, a mesothelioma, a lung cancer, a non-small cell lung cancer, a stage IV lung cancer, a brain cancer, a glioblastoma, a lymphoma, a leukemia, a multiple myeloma (MM); a solid tumor or a cancer affecting the blood and/or bone marrow; or a cancer or tumor in a tissue which normally lacks expression (or has a low expression level) of a PTEN protein, optionally wherein the cancer or tumor having an H score of about 20 or lower, wherein the H score is calculated as the product of the percentage of cells staining at an established intensity (0=no staining, 1+=intermediate/decreased, 2+=full) relative to the internal positive control (which can be endothelium or tumor stroma, set at 2+) giving a product ranging from 0 to 200, optionally wherein the staining intensity of the IHC sample is evaluated blindly by at least two independent pathologists or is computer assisted.

Embodiment 71

The method of any one of embodiments 68 to 70, wherein the cancer or tumor comprises an inactive PTEN, and optionally wherein the cancer or tumor lacks expression of a PTEN protein.

Embodiment 72

The method of any one of embodiments 68 to 71, wherein the cancer or tumor comprises an increased pi3K pathway pharmacodynamics biomarkers compared to a control.

Embodiment 73

The method of embodiment 72, wherein the control is a biological sample from a subject who is free of any cancer or tumor, and/or, wherein the control is any other cancer or tumor.

Embodiment 74

The method of any one of embodiments 72 to 73, wherein the biomarker is one or more biomarker(s) selected from the group of: AKT, pPRAS40, pS6K, pGSK3, or pFOXO.

Embodiment 75

The method of any one of embodiments 68 to 74, wherein the vector further comprises a polynucleotide encoding a heterologous protein or polypeptide, optionally wherein the heterologous protein comprises a PTEN or a fragment, analogue, variant, mutant, or equivalent of, optionally wherein the heterologous protein comprises an amino acid sequence selected from SEQ ID NOs: 31-33, 1-2, 88-89, 6-8, 201-203, optionally wherein the heterologous protein or polypeptide comprises an amino acid sequence of an albumin and an amino acid sequence of a p53 protein, optionally wherein the polynucleotide encoding a heterologous protein is selected from SEQ ID NO:78 or 161, optionally the heterologous protein is a monoclonal antibody (mAb) or an equivalent thereof, and further optionally the heterologous protein is selected from a mAb or an equivalent thereof recognizing and binding to VEGFR (such as Avastin™), a mAb or an equivalent thereof recognizing and binding to HER2 (such as Herceptin™), a mAb or an equivalent thereof recognizing and binding to EGFR (such as Erbitux™), a mAb or an equivalent thereof that regulates immune checkpoints {such as one recognizing and binding to CTLA4 [for example Yervoy™ (ipilimumab)], or one recognizing and binding to PD-1 [for example Keytruda™ (pembrolizumab) and Opdivo™ (nivolumab)], or one recognizing and binding to PD-L1 (for example, Tecentriq™ (atezolizumab)]}, Granulocyte-macrophage colony-stimulating factor (GM-CSF) or an equivalent thereof, an interleukin such as IL-2 or IL-15, an interferon such IFNβ or IFNγ, a natural bioactive peptide (such as thymosin A or adiponectin), or a synthetic peptide such as hexarelin.

Embodiment 76

A method for inhibiting growth of a cancer cell, comprising contacting the cell with an effective amount of one or more of the following: a fusion protein of any one of embodiments 1 to 52, a polynucleotide of any one of embodiments 53 to 55, a vector of any one of embodiments 56 to 58, or a pharmaceutical composition of any one of embodiments 61 to 66.

Embodiment 77

The method of embodiment 76, wherein the contacting is in vitro, ex vivo or in vivo.

Embodiment 78

A method for delivering a fusion protein to a subject, comprising administering an effective amount of one or more of the following: a fusion protein of any one of embodiments 1 to 52, a polynucleotide of any one of embodiments 53 to 55, a vector of any one of embodiments 56 to 58, or a pharmaceutical composition of any one of embodiments 61 to 66 to a subject in need thereof, thereby delivering the fusion protein to the subject, and optionally whereby delivery the fusion protein to the extracellular matrix (ECM) of a tumor or cancer of the subject.

Embodiment 79

A method of producing a fusion protein of any one of embodiments 1 to 52, comprising
  (i) culturing a host cell capable of expressing the fusion protein under conditions suitable for expression of the fusion protein, and optionally wherein the host cell lacks (or has a low level of) expression of a protease which is able to cleave the fusion protein; and
  (ii) purifying or isolating the fusion protein optionally from the cell or cell culture medium, optionally comprising an albumin affinity chromatography and/or a heparin affinity chromatography,
  i. whereby achieving a high yield, a low aggregation, and/or a high stability compared to a produced wildtype PTEN-L protein, and optionally wherein after or during the culture, supernatant of host cells comprises more than about 5 µg/ml of secreted fusion protein.

Embodiment 80

A method of manufacturing a fusion protein having a high yield, a high stability and/or a low aggregation, comprising
  (i) culturing a host cell capable of expressing the fusion protein under conditions suitable for expression of the fusion protein, and optionally wherein the host cell lacks (or has a low level of) expression of a protease which is able to cleave the fusion protein; and
  (ii) purifying or isolating the fusion protein, optionally from the cell or cell culture medium, optionally comprising an albumin affinity chromatography and/or a heparin affinity chromatography.

Embodiment 81

The method of embodiment 79 or 80, wherein the host cell comprises a polynucleotide of any one of embodiments 53 to 55, and/or a vector of any one of embodiments 56 to 58.

Embodiment 82

The method of any one of embodiments 79 to 81, further comprising lysing host cells to release the fusion protein expressed, or wherein the fusion protein is secreted outside of the host cells.

Embodiment 83

The method of any one of embodiments 79 to 82 wherein the host cell is selected from the group of a Chinese hamster ovary (CHO) cell, or a HEK293 cell, optionally wherein the CHO cell is a CHO-3E7 cell having an ExPASy accession number of CVCL_JY74, optionally wherein the HEK293 cell is a HEK293-EBNA1-6E having an ExPASy accession number of CVCL_HF20, further optionally wherein the host cell lacks expression of a protease, optionally wherein the protease is an intracellular protease or a protease present in a peri-cancerous cell or tissue, and optionally wherein the protease is selected from the group of furin, MMP2/9 or Cathepsin B, optionally wherein the host cell is a natural furin knock-out (KO) cell, and further optionally wherein the host cell is LoVo cells.

EQUIVALENTS

It is to be understood that while the disclosure has been described in conjunction with the above embodiments, that the foregoing description and examples are intended to illustrate and not limit the scope of the disclosure. Other aspects, advantages and modifications within the scope of the disclosure will be apparent to those skilled in the art to which the disclosure pertains.

The disclosures illustratively described herein may suitably be practiced in the absence of any element or elements, limitation or limitations, not specifically disclosed herein. Thus, for example, the terms "comprising", "including," "containing", etc. shall be read expansively and without limitation. Additionally, the terms and expressions employed herein have been used as terms of description and not of limitation, and there is no intention in the use of such terms and expressions of excluding any equivalents of the features shown and described or portions thereof, but it is recognized that various modifications are possible within the scope of the disclosure claimed.

Thus, it should be understood that although the present disclosure has been specifically disclosed by preferred embodiments and optional features, modification, improvement and variation of the disclosures embodied therein herein disclosed may be resorted to by those skilled in the art, and that such modifications, improvements and variations are considered to be within the scope of this disclosure. The materials, methods, and examples provided here are representative of preferred embodiments, are exemplary, and are not intended as limitations on the scope of the disclosure.

The disclosure has been described broadly and generically herein. Each of the narrower species and subgeneric groupings falling within the generic disclosure also form part of the disclosure. This includes the generic description of the disclosure with a proviso or negative limitation removing any subject matter from the genus, regardless of whether or not the excised material is specifically recited herein.

In addition, where features or aspects of the disclosure are described in terms of Markush groups, those skilled in the art will recognize that the disclosure is also thereby described in terms of any individual member or subgroup of members of the Markush group.

All publications, patent applications, patents, and other references mentioned herein are expressly incorporated by reference in their entirety, to the same extent as if each were incorporated by reference individually. In case of conflict, the present specification, including definitions, will control.

REFERENCES

Altinoğlu et al, 2016: PMID: 27748775. Intracellular delivery of the PTEN protein using cationic lipidoids for cancer therapy. Biomater Sci. 2016 Nov. 15; 4(12):1773-1780.

Biniossek et al, 2011: PMID: 21967108. Proteomic identification of protease cleavage sites characterizes prime and non-prime specificity of cysteine cathepsins B, L, and S. J Proteome Res. 2011 Dec. 2; 10(12):5363-73. doi: 10.1021/pr200621z. Epub 2011 Oct. 26. Erratum in: J Proteome Res. 2011 Dec. 2; 10(12):5577.

Bonamassa et al, 2011: PMID: 21191634. Hydrodynamic gene delivery and its applications in pharmaceutical research. Pharm Res. 2011 April; 28(4):694-701. doi: 10.1007/s11095-010-0338-9. Epub 2010 Dec. 30.

Bourbeau et al, 2007: PMID: 17409449. Improvement of antitumor activity by gene amplification with a replicating but nondisseminating adenovirus. Cancer Res. 2007 Apr. 1; 67(7):3387-95.

Braun & Sauter, 2019: PMID: 31406574. Furin-mediated protein processing in infectious diseases and cancer. Clin Transl Immunology. 2019 Aug. 5; 8(8): e1073. doi: 10.1002/cti2.1073. eCollection 2019.

Chen & Eng, 2019: PMID: 30928438. PTEN Mutations Trigger Resistance to Immunotherapy. Trends Mol Med. 2019 June; 25(6):461-463. doi: 10.1016/j.molmed.2019.03.003. Epub 2019 Mar. 27.

Durocher & Loignon, 2009:patents.google.com/patent/US8637315

Feng & Tsao, 2016: PMID: 27699004. Emerging role of microRNA-21 in cancer. Biomed Rep. 2016 October; 5(4):395-402. Epub 2016 Aug. 26.

Gilbert et al, 2013. A Cell Line for Large-Scale Production of Nondisseminative Adenoviral Vectors (Deleted of Protease [PS] Gene) for Cancer Therapy and Vaccination. Abstract #135; DOI: 10.1016/51525-0016(16)34470-7.

Gilbert R et al, 2014: PMID: 25159033. Establishment and validation of new complementing cells for production of E1-deleted adenovirus vectors in serum-free suspension culture. J Virol Methods. 2014 November; 208:177-88. doi: 10.1016/j.jviromet.2014.08.013. Epub 2014 Aug. 23.

Haq et al, 2019; PMID: 31506193. Evaluation of recombinant adenovirus vectors and adjuvanted protein as a heterologous prime-boost strategy using HER2 as a model antigen. Vaccine. 2019 Nov. 8; 37(47):7029-7040. doi: 10.1016/j.vaccine.2019.08.079. Epub 2019 Sep. 7.

Goswami et al, 2019: PMID: 31069169; Gene Therapy Leaves a Vicious Cycle. Front Oncol. 2019 Apr. 24; 9:297. doi: 10.3389/fonc.2019.00297. eCollection 2019

Güler-Gane et al, 2016: PMID: 27195765. Overcoming the Refractory Expression of Secreted Recombinant Proteins in Mammalian Cells through Modification of the Signal Peptide and Adjacent Amino Acids. PLoS One. 2016 May 19; 11(5): e0155340. doi: 10.1371/journal.pone.0155340. eCollection 2016.

Hopkins et al, 2013: PMID: 23744781; A secreted PTEN phosphatase that enters cells to alter signaling and survival. Science. 2013 Jul. 26; 341(6144):399-402. doi: 10.1126/science.1234907. Epub 2013 Jun. 6.

Jabłońska-Trypuć et al, 2016: PMID: 27028474. Matrix metalloproteinases (MMPs), the main extracellular matrix (ECM) enzymes in collagen degradation, as a target for anticancer drugs. J Enzyme Inhib Med Chem. 2016; 31(supl):177-183. Epub 2016 Mar. 30.

Kudelka et al, 2015: PMID: 25727146. Simple sugars to complex disease—mucin-type O-glycans in cancer. Adv Cancer Res. 2015; 126:53-135. doi: 10.1016/bs.acr.2014.11.002. Epub 2015 Feb. 7. Review.

Li C et al, 2018: PMID: 29316891. Serum miR-486-5p as a diagnostic marker in cervical cancer: with investigation of potential mechanisms. BMC Cancer. 2018 Jan. 9; 18(1): 61. doi: 10.1186/s12885-017-3753-z.

Li Y et al, 2018: PMID: 29704427. Cancer/testis antigen-Plac1 promotes invasion and metastasis of breast cancer through Furin/NICD/PTEN signaling pathway. Mol Oncol. 2018 August; 12(8):1233-1248. doi: 10.1002/1878-0261.12311. Epub 2018 Jun. 14.

Liang et al, 2014: PMID: 24768297. PTENα, a PTEN isoform translated through alternative initiation, regulates mitochondrial function and energy metabolism. Cell Metab. 2014 May 6; 19(5):836-48. doi: 10.1016/j.cmet.2014.03.023. Epub 2014 Apr. 24.

Liang et al, 2017: PMID: 28332494. PTEN is an alternatively translated isoform of PTEN that regulates rDNA transcription. Nat Commun. 2017 Mar. 23; 8:14771. doi: 10.1038/ncomms14771.

Mahmoodi Chalbatani G et al, 2019: PMID: 31118626. Small interfering RNAs (siRNAs) in cancer therapy: a nano-based approach. Int J Nanomedicine. 2019 May 2; 14:3111-3128. doi: 10.2147/IJN.S200253. eCollection 2019.

Malaney et al, 2013: PMID: 24056727. The PTEN Long N-tail is intrinsically disordered: increased viability for PTEN therapy. Mol Biosyst. 2013 November; 9(11): 2877-88. doi: 10.1039/c3mb70267g.

Malaney et al, 2017: PMID: 28289760. PTEN proteoforms in biology and disease. Cell Mol Life Sci. 2017 August; 74(15):2783-2794. doi: 10.1007/s00018-017-2500-6. Epub 2017 Mar. 13.

Masson et al, 2016: PMID: 26527737. The intrinsically disordered tails of PTEN and PTEN-L have distinct roles in regulating substrate specificity and membrane activity. Biochem J. 2016 Jan. 15; 473(2):135-44. doi: 10.1042/BJ20150931. Epub 2015 Nov. 2.

Meuillet et al, 2004: PMID: 15313215. Thioredoxin-1 binds to the C2 domain of PTEN inhibiting PTEN's lipid phosphatase activity and membrane binding: a mechanism for the functional loss of PTEN's tumor suppressor activity. Arch Biochem Biophys. 2004 Sep. 15; 429(2): 123-33.

Mingo et al, 2019: PMID: 30993208. Precise definition of PTEN C-terminal epitopes and its implications in clinical oncology. NPJ Precis Oncol. 2019 Apr. 15; 3:11. doi: 10.1038/s41698-019-0083-4. eCollection 2019.

Odriozola et al, 2007: PMID: 17565999. Regulation of PTEN activity by its carboxyl-terminal autoinhibitory domain. J Biol Chem. 2007 Aug. 10; 282(32):23306-15. Epub 2007 Jun. 12.

Prudova et al, 2010: PMID: 20305284. Multiplex N-terminome analysis of MMP-2 and MMP-9 substrate degradomes by iTRAQ-TAILS quantitative proteomics. Mol Cell Proteomics. 2010 May; 9(5):894-911. doi: 10.1074/mcp.M000050-MCP201. Epub 2010 Mar. 20.

Pulido et al, 2014: PMID: 24985344. A unified nomenclature and amino acid numbering for human PTEN. Sci Signal. 2014 Jul. 1; 7(332):pe15. doi: 10.1126/scisignal.2005560.

Pulido et al, 2019: PMID: 31501265. Precise Immunodetection of PTEN Protein in Human Neoplasia. Cold Spring Harb Perspect Med. 2019 Dec. 2; 9(12). pii: a036293. doi: 10.1101/cshperspect.a036293.

Rubartelli & Sitia R, 1991: PMID: 1889608. Interleukin 1 beta and thioredoxin are secreted through a novel pathway of secretion. Biochem Soc Trans. 1991 April; 19(2):255-9.

Rulle et al, 2018: PMID: 30240851. Computer-Based Intensity Measurement Assists Pathologists in Scoring Phosphatase and Tensin Homolog Immunohistochemistry—Clinical Associations in NSCLC Patients of the European Thoracic Oncology Platform Lungscape Cohort. J Thorac Oncol. 2018 December; 13(12):1851-1863. doi: 10.1016/j.jtho.2018.08.2034. Epub 2018 Sep. 18.

Russell et al, 2018: PMID: 30479334. PTEN expression by an oncolytic herpesvirus directs T-cell mediated tumor clearance. Nat Commun. 2018 Nov. 27; 9(1):5006. doi: 10.1038/s41467-018-07344-1.

Ryu et al, 2020: PMID: 32057052. Modular protein-DNA hybrid nanostructures as a drug delivery platform. Nanoscale. 2020 Feb. 14. doi: 10.1039/c9nr08519j. [Epub ahead of print].

Sak-Ubol et al, 2016: PMID: 27176608. Secretory production of a beta-mannanase and a chitosanase using a *Lactobacillus plantarum* expression system. Microb Cell Fact. 2016 May 12; 15:81. doi: 10.1186/s12934-016-0481-z.

Sand et al, 2015: PMID: 25674083. Unraveling the Interaction between FcRn and Albumin: Opportunities for Design of Albumin-Based Therapeutics. Front Immunol. 2015 Jan. 26; 5:682. doi: 10.3389/fimmu.2014.00682. eCollection 2014.

Sangale et al, 2011: PMID: 20930614. A robust immunohistochemical assay for detecting PTEN expression in human tumors. Appl Immunohistochem Mol Morphol. 2011 March; 19(2):173-83. doi: 10.1097/PAI.0b013e3181f1da13.

Schmidt et al, 2017: PMID: 28637874. Direct demonstration of a neonatal Fc receptor (FcRn)-driven endosomal sorting pathway for cellular recycling of albumin. J Biol Chem. 2017 Aug. 11; 292(32):13312-13322. doi: 10.1074/jbc.M117.794248. Epub 2017 Jun. 21.

Spinelli & Leslie, 2015: PMID: 25461809. Assaying PTEN catalysis in vitro. Methods. 2015 May; 77-78:51-7. doi: 10.1016/j.ymeth.2014.11.003. Epub 2014 Nov. 13.

Strohl W R, 2015: PMID: 26177629. Fusion Proteins for Half-Life Extension of Biologics as a Strategy to Make Biobetters. BioDrugs. 2015 August; 29(4):215-39. doi: 10.1007/s40259-015-0133-6.

Susan-Resiga et al. 2011: PMID: 21550985. Furin is the major processing enzyme of the cardiac-specific growth factor bone morphogenetic protein 10. J Biol Chem. 2011 Jul. 1; 286(26):22785-94. doi: 10.1074/jbc.M111.233577. Epub 2011 May 5.

Suzuki et al, 2015: PMID: 25588742. Preferable sites and orientations of transgene inserted in the adenovirus vector genome: The E3 site may be unfavorable for transgene position. Gene Ther. 2015 May; 22(5):421-9. doi: 10.1038/gt.2014.124. Epub 2015 Jan. 15.

Swiercz et al, 2017: PMID: 27974681. Loss of expression of the recycling receptor, FcRn, promotes tumor cell growth by increasing albumin consumption. Oncotarget. 2017 Jan. 10; 8(2):3528-3541. doi: 10.18632/oncotarget.13869.

Tian et al, 2016: PMID: 21541042. FurinDB: A database of 20-residue furin cleavage site motifs, substrates and their associated drugs. Int J Mol Sci. 2011 Feb. 8; 12(2):1060-5.

Tzani et al, 2016: PMID: 27249819. Systematic analysis of the PTEN 5' leader identifies a major AUU initiated proteoform. Open Biol. 2016 May; 6(5). pii: 150203. doi: 10.1098/rsob.150203. Epub 2016 May 25.

Vidak et al, 2019: PMID: 30897858. Cysteine Cathepsins and their Extracellular Roles: Shaping the Microenvironment. Cells. 2019 Mar. 20; 8(3). pii: E264. doi: 10.3390/cells8030264.

Wu et al, 2017: PMID: 28783500. Treatment with PTEN-Long protein inhibits hepatitis C virus replication. Virology. 2017 November; 511:1-8. doi: 10.1016/j.virol.2017.08.002. Epub 2017 Aug. 4.

Zhao et al, 2013: PMID: 23951172. In vivo monitoring of angiogenesis inhibition via down-regulation of mir-21 in a VEGFR2-luc murine breast cancer model using bioluminescent imaging. PLoS One. 2013 Aug. 8; 8(8): e71472. doi: 10.1371/journal.pone.0071472. eCollection 2013.

Zhao et al, 2014: PMID: 24671154. A novel oncolytic herpes simplex virus type 2 has potent anti-tumor activity. PLoS One. 2014 Mar. 26; 9(3): e93103. doi: 10.1371/journal.pone.0093103. eCollection 2014.

Zhu et al, 2015: PMID: 26078940. Molecular Analysis of AFP and HSA Interactions with PTEN Protein. Biomed Res Int. 2015; 2015:256916. doi: 10.1155/2015/256916. Epub 2015 May 20.

SEQUENCE LISTING (224 sequences)

SEQ ID NO: 1 - protein, 576 aa, Homo sapiens
LERGGEAAAAAAAAAAAPGRGSESPVTISRAGNAGELVSPLLLPPTRRRRRRHIQGPGPVLNLPSAAAAPPVARAPEAAGGGSRSEDYSSSPHSAAAAARPLAAEEKQAQSLQPSSSRRSSHYPAAVQSQAAAERGASATAKSRAISILQKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKV

SEQ ID NO: 2 - protein, 403 aa, Homo sapiens [sequence omitted]

SEQ ID NO: 3 - protein, 555 aa, Homo sapiens
SESPVTISRAGNAGELVSPLLLPPTRRRRRRHIQGPGPVLNLPSAAAAPPVARAPEAAGGGSRSEDYSSSPHSAAAAARPLAAEEKQAQSLQPSSSRRSSHYPAAVQSQAAAERGASATAKSRAISILQKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKV

SEQ ID NO: 4 - protein, 21 aa, Homo sapiens
LERGGEAAAAAAAAAAAPGRG

SEQ ID NO: 5 - protein, 152 aa, Homo sapiens
SESPVTISRAGNAGELVSPLLLPPTRRRRRRHIQGPGPVLNLPSAAAAPPVARAPEAAGGGSRSEDYSSSPHSAAAAARPLAAEEKQAQSLQPSSSRRSSHYPAAVQSQAAAERGASATAKSRAISILQKKPRHQQLLPSLSSFFFSHRLPD

SEQ ID NO: 6 - protein, 549 aa, Homo sapiens
ISRAGNAGELVSPLLLPPTRRRRRRHIQGPGPVLNLPSAAAAPPVARAPEAAGGGSRSEDYSSSPHSAAAAARPLAAEEKQAQSLQPSSSRRSSHYPAAVQSQAAAERGASATAKSRAISILQKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKV

SEQ ID NO: 7 - protein, 534 aa, Homo sapiens
LPPTRRRRRRHIQGPGPVLNLPSAAAAPPVARAPEAAGGGSRSEDYSSSPHSAAAAARPLAAEEKQAQSLQPSSSRRSSHYPAAVQSQAAAERGASATAKSRAISILQKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKV

SEQ ID NO: 8 - protein, 475 aa, Homo sapiens
LAAEEKQAQSLQPSSSRRSSHYPAAVQSQAAAERGASATAKSRAISILQKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKV

SEQ ID NO: 9 - protein, 146 aa, Homo sapiens
ISRAGNAGELVSPLLLPPTRRRRRRHIQGPGPVLNLPSAAAAPPVARAPEAAGGGSRSEDYSSSPHSAAAAARPLAAEEKQAQSLQPSSSRRSSHYPAAVQSQAAAERGASATAKSRAISILQKKPRHQQLLPSLSSFFFSHRLPD

SEQ ID NO: 10 - protein, 131 aa, Homo sapiens
LPPTRRRRRRHIQGPGPVLNLPSAAAAPPVARAPEAAGGGSRSEDYSSSPHSAAAAARPLAAEEKQAQSLQPSSSRRSSHYPAAVQSQAAAERGASATAKSRAISILQKKPRHQQLLPSLSSFFFSHRLPD

SEQ ID NO: 11 - protein, 72 aa, Homo sapiens
LAAEEKQAQSLQPSSSRRSSHYPAAVQSQAAAERGASATAKSRAISILQKKPRHQQLLPSLSSFFFSHRLPD

SEQ ID NO: 12 - protein, 609 aa, Homo sapiens [sequence omitted]

SEQ ID NO: 13 - protein, 585 aa, Homo sapiens [sequence omitted]

SEQ ID NO: 14 - protein, 1177 aa, Artificial Sequence
  Description of Artificial Sequence: Synthetic polypeptide
MKWVTFISLLFLFSSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLTNRRKKRALDAAYISRAGNAGELVSPLLLPPTRRRRRRHIQGPGPVLNLPSAAAAPPVARAPEAAGGGSRSEDYSSSPHSAAAAARPLAAEEKQAQSLQPSSSRRSSHYPAAVQSQAAAERGASATAKSRAISILQKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKVHHHHHH

SEQ ID NO: 15 - protein, 1172 aa, Artificial Sequence
  Description of Artificial Sequence: Synthetic polypeptide
MKWVTFISLLFLFSSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGPAALKAAISRAGNAGELVSPLLLPPTRRRRRRHIQGPGPVLNLPSAAAAPPVARAPEAAGGGSRSEDYSSSPHSAAAAARPLAAEEKQAQSLQPSSSRRSSHYPAAVQSQAAAERGASATAKSRAISILQKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKVHHHHHH

SEQ ID NO: 16 - protein, 1164 aa, Artificial Sequence
  Description of Artificial Sequence: Synthetic polypeptide
MKWVTFISLLFLFSSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLISRAGNAGELVSPLLLPPTRRRRRRHIQGPGPVLNLPSAAAAPPVARAPEAAGGGSRSEDYSSSPHSAAAAARPLAAEEKQAQSLQPSSSRRSSHYPAAVQSQAAAERGASATAKSRAISILQKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKVHHHHHH

SEQ ID NO: 17 - protein, 1185 aa, Artificial Sequence
  Description of Artificial Sequence: Synthetic polypeptide
MKWVTFISLLFLFSSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGPAALKAATNRRKKRALDAAYISRAGNAGELVSPLLLPPTRRRRRRHIQGPGPVLNLPSAAAAPPVARAPEAAGGGSRSEDYSSSPHSAAAAARPLAAEEKQAQSLQPSSSRRSSHYPAAVQSQAAAERGASATAKSRAISILQKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKVHHHHHH

SEQ ID NO: 18 - protein, 1022 aa, Artificial Sequence
  Description of Artificial Sequence: Synthetic polypeptide
MKWVTFISLLFLFSSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKVYPYDVPDYAC

SEQ ID NO: 19 - protein, 1018 aa, Artificial Sequence
  Description of Artificial Sequence: Synthetic polypeptide
MKWVTFISLLFLFSSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKVHHHHHH

SEQ ID NO: 20 - protein, 1031 aa, Artificial Sequence
  Description of Artificial Sequence: Synthetic polypeptide
MKWVTFISLLFLFSSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLTNRRKKRALDAAYMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKVHHHHHH

SEQ ID NO: 21 - protein, 1057 aa, Artificial Sequence
  Description of Artificial Sequence: Synthetic polypeptide
MKWVTFISLLFLFSSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLPPTRRRRRRHIQGPGPKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKVHHHHHH

SEQ ID NO: 22 - protein, 1070 aa, Artificial Sequence
  Description of Artificial Sequence: Synthetic polypeptide
MKWVTFISLLFLFSSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLTNRRKKRALDAAYPPTRRRRRRHIQGPGPKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKVHHHHHH

SEQ ID NO: 23 - protein, 1055 aa, Artificial Sequence
  Description of Artificial Sequence: Synthetic polypeptide
MKWVTFISLLFLFSSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLLPPTRRRRRRHIQGPGPVLNLPSAAAAPPVARAPEAAMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKVHHHHHH

SEQ ID NO: 24 - protein, 1059 aa, Artificial Sequence
  Description of Artificial Sequence: Synthetic polypeptide
MKWVTFISLLFLFSSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGSRSEDYSSSPHSAAAAARPLAAEEKQAQSLQPSSSRRSMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKVHHHHHH

SEQ ID NO: 25 - protein, 1071 aa, Artificial Sequence
  Description of Artificial Sequence: Synthetic polypeptide
MKWVTFISLLFLFSSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLSHYPAAVQSQAAAERGASATAKSRAISILQKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKVHHHHHH

SEQ ID NO: 26 - protein, 1199 aa, Artificial Sequence
  Description of Artificial Sequence: Synthetic polypeptide
MKWVTFISLLFLFSSAYSRGVFRRSESPVTISRAGNAGELVSPLLLPPTRRRRRRHIQGPGPVLNLPSAAAAPPVARAPEAAGGGSRSEDYSSSPHSAAAAARPLAAEEKQAQSLQPSSSRRSSHYPAAVQSQAAAERGASATAKSRAISILQKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKVHHHHHHGPAALKAATNRRKKRALDAAYDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLDYKDDDDK

SEQ ID NO: 27 - protein, 1183 aa, Artificial Sequence
  Description of Artificial Sequence: Synthetic polypeptide
MKWVTFISLLFLFSSAYSRGVFRRSESPVTISRAGNAGELVSPLLLPPTRRRRRRHIQGPGPVLNLPSAAAAPPVARAPEAAGGGSRSEDYSSSPHSAAAAARPLAAEEKQAQSLQPSSSRRSSHYPAAVQSQAAAERGASATAKSRAISILQKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKVTNRRKKRALDAAYDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 28 - protein, 1170 aa, Artificial Sequence
  Description of Artificial Sequence: Synthetic polypeptide
MKWVTFISLLFLFSSAYSRGVFRRSESPVTISRAGNAGELVSPLLLPPTRRRRRRHIQGPGPVLNLPSAAAAPPVARAPEAAGGGSRSEDYSSSPHSAAAAARPLAAEEKQAQSLQPSSSRRSSHYPAAVQSQAAAERGASATAKSRAISILQKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKVDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 29 - protein, 1063 aa, Artificial Sequence
  Description of Artificial Sequence: Synthetic polypeptide
MKWVTFISLLFLFSSAYSRGVFRRSESPVTPPTRRRRRRHIQGPGPKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKVDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 30 - protein, 1076 aa, Artificial Sequence
  Description of Artificial Sequence: Synthetic polypeptide
MKWVTFISLLFLFSSAYSRGVFRRSESPVTPPTRRRRRRHIQGPGPKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKVTNRRKKRALDAAYDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 31 - protein, 585 aa, Artificial Sequence
  Description of Artificial Sequence: Synthetic polypeptide
MKWVTFISLLFLFSSAYSRGVFRRSESPVTISRAGNAGELVSPLLLPPTRRRRRRHIQGPGPVLNLPSAAAAPPVARAPEAAGGGSRSEDYSSSPHSAAAAARPLAAEEKQAQSLQPSSSRRSSHYPAAVQSQAAAERGASATAKSRAISILQKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKVHHHHHH

SEQ ID NO: 32 - protein, 580 aa, Artificial Sequence
  Description of Artificial Sequence: Synthetic polypeptide
MEFGLSWVFLVAILKGVQCSESPVTISRAGNAGELVSPLLLPPTRRRRRRHIQGPGPVLNLPSAAAAPPVARAPEAAGGGSRSEDYSSSPHSAAAAARPLAAEEKQAQSLQPSSSRRSSHYPAAVQSQAAAERGASATAKSRAISILQKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKVHHHHHH

SEQ ID NO: 33 - protein, 585 aa, Artificial Sequence
  Description of Artificial Sequence: Synthetic polypeptide
MKWVTFISLLFLFSSAYSRGVFRRSESPVTPSRAGNAGELVSPLLPPPTRRRRRRHIQGPGPVLNLPSAAAAPPVARAPEAAGGGSRSEDYSSSPHSAAAAARPPAAEEKQAQSLQPSSSRRSSHYPAAVQSQAAAERGASATAKSRAISILQKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKVHHHHHH

SEQ ID NO: 34 - protein, 799 aa, Artificial Sequence
  Description of Artificial Sequence: Synthetic polypeptide
MEFGLSWVFLVAILKGVQCSESPVTISRAGNAGELVSPLLLPPTRRRRRRHIQGPGPVLNLPSAAAAPPVARAPEAAGGGSRSEDYSSSPHSAAAAARPLAAEEKQAQSLQPSSSRRSSHYPAAVQSQAAAERGASATAKSRAISILQKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKVHHHHHHPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 35 - protein, 811 aa, Artificial Sequence
  Description of Artificial Sequence: Synthetic polypeptide
MEFGLSWVFLVAILKGVQCSESPVTISRAGNAGELVSPLLLPPTRRRRRRHIQGPGPVLNLPSAAAAPPVARAPEAAGGGSRSEDYSSSPHSAAAAARPLAAEEKQAQSLQPSSSRRSSHYPAAVQSQAAAERGASATAKSRAISILQKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKVHHHHHHEPKSSDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 36 - protein, 798 aa, Artificial Sequence
  Description of Artificial Sequence: Synthetic polypeptide
MEFGLSWVFLVAILKGVQCPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSISRAGNAGELVSPLLLPPTRRRRRRHIQGPGPVLNLPSAAAAPPVARAPEAAGGGSRSEDYSSSPHSAAAAARPLAAEEKQAQSLQPSSSRRSSHYPAAVQSQAAAERGASATAKSRAISILQKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKVHHHHHH

SEQ ID NO: 37 - protein, 995 aa, Artificial Sequence
  Description of Artificial Sequence: Synthetic polypeptide
MKWVTFISLLFLFSSAYSRGVFRRYPYDVPDYACMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKVGGGGSRAGNAGELVSPLLLPPTRRRRRRHIQGPGPVLNLPSAAAAPPVARAPEAAGGGSRSEDYSSSPHSAAAAARPLAAEEKQAQSLQPSSSRRSSHYPAAVQSQAAAERGASATAKSRAISILQKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKVHHHHHH

SEQ ID NO: 38 - protein, 1159 aa, Artificial Sequence
  Description of Artificial Sequence: Synthetic polypeptide
MKWVTFISLLFLFSSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLISRAGNAGELVSPLLLPPTRRRRRRHIQGPGPVLNLPSAAAAPPVARAPEAAGGGSRSEDYSSSPHSAAAAARPLAAEEKQAQSLQPSSSRRSSHYPAAVQSQAAAERGASATAKSRAISILQKKPRHQQLLPSLSSFFFSHRLPDGGGGSMEEPQSDPSVEPPLSQETFSDLWKLLPENNVLSPLPSQAMDDLMLSPDDIEQWFTEDPGPDEAPRMPEAAPPVAPAPAAPTPAAPAPAPSWPLSSSVPSQKTYQGSYGFRLGFLHSGTAKSVTCTYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQIRGRERFEMFRELNEALELKDAQAGKEPGGSRAHSSHLKSKKGQSTSRHKKLMFKTEGPDSDHHHHHH

SEQ ID NO: 39 - protein, 6 aa, Artificial Sequence
  Description of Artificial Sequence: Synthetic peptide
RRRRRR

SEQ ID NO: 40 - protein, 23 aa, Homo sapiens
KKPRHQQLLPSLSSFFFSHRLPD

SEQ ID NO: 41 - DNA, 1743 bp, Artificial Sequence
  Description of Artificial Sequence: Synthetic polynucleotide
atgaaacgcatgaaatcgctggctgcggcgctcaccgtcgctggggccatgctggccgcacctgtggcaacggcatccgagtctcctgtgaccatctctcgcgctggcaacgctggcgagcttgtctctccgctgctgcttcctcctacccgtcgtcgtcgtcgtcgccacatccagggtccaggcccagtgctgaacctgccatccgcagctgctgcaccaccagttgcacgtgcaccagaagctgccggcggtggctcccgctccgaggactactcctcctccccacactccgcagctgctgcagctcgcccactggcagcagaagagaagcaggcacagtccctgcagccatcctcctcccgccgctcctcccactacccagctgctgttcagtcccaggcagctgctgaacgcggtgcttccgcaaccgcaaagtcccgtgcaatctccatcctgcagaagaagccacgccaccagcagctgctgccatccctgtcctccttcttcttctcccaccgcctgccagacatgaccgctatcatcaaggaaatcgtttcccgcaacaagcgccgctaccaggaagatggcttcgatctggacctgacctacatctacccaaacatcatcgcaatgggtttcccagctgaacgcctggagggcgtgtaccgcaacaacatcgatgacgtggtccgcttcctggactccaagcacaagaaccactacaagatctacaacctgtgcgctgaacgccactacgataccgccaagttcaactgccgcgtcgcacagtacccattcgaggaccacaacccaccacagctggaactgatcaagccattctgcgaggatctggaccagtggctgtccgaagatgacaaccacgttgcagctatccactgcaaggctggcaagggccgcaccggtgtgatgatctgcgcctacctgctgcaccgcggcaagttcctgaaggctcaggaagccctggatttctacggtgaggttcgcacccgcgacaagaagggcgtgaccatcccatcccagcgccgctacgtgtactactactcctacctgctgaagaaccacctggattaccgcccagtcgctctgctgttccacaagatgatgttcgaaaccatcccaatgttctccggtggcacctgcaacccacagttcgttgtgtgccagctgaaggtcaagatctactcctccaactccggtccaacccgtcgcgaggataagttcatgtacttcgagttcccacagccactgccagtgtgcggcgacatcaaggtcgaattcttccacaagcagaacaagatgctgaagaaggataagatgttccacttctgggtcaacaccttcttcatcccaggtccagaagaaacctctgaaaaggttgagaacggctccctgtgcgatcaggagatcgactccatctgctccatcgaacgcgcagataacgacaaggagtacctggttctgaccctgaccaagaacgatctggacaaggccaacaaggacaaggcaaaccgctacttctccccaaacttcaaggtcaagctgtacttcaccaagaccgttgaagagccatccaacccagaagcttcctcctccacctctgtgaccccagatgtttccgacaacgagccagatcactaccgctactccgataccaccgactccgaccctgagaacgagccattcgacgaggaccagcacacccagattaccaaagtctaa

SEQ ID NO: 42 - DNA, 1776 bp, Artificial Sequence
  Description of Artificial Sequence: Synthetic polynucleotide
atgtttaacaaccgtatccgcactgcagctctcgctggtgcaatcgcaatctccaccgcagcttccggcgtagctatcccagcattcgctgcagagaccaacccaacctccgagtcccctgtgaccatctcccgcgccggcaacgctggtgaactcgtgtccccgctcctcctccctccgacccgccgtcgtcgccgtcgccacatccagggtccaggcccagtgctgaacctgccatccgcagctgctgcaccaccagttgcacgtgcaccagaagctgccggcggtggctcccgctccgaggactactcctcctccccacactccgcagctgctgcagctcgcccactggcagcagaagagaagcaggcacagtccctgcagccatcctcctcccgccgctcctcccactacccagctgctgttcagtcccaggcagctgctgaacgcggtgcttccgcaaccgcaaagtcccgtgcaatctccatcctgcagaagaagccacgccaccagcagctgctgccatccctgtcctccttcttcttctcccaccgcctgccagacatgaccgctatcatcaaggaaatcgtttcccgcaacaagcgccgctaccaggaagatggcttcgatctggacctgacctacatctacccaaacatcatcgcaatgggtttcccagctgaacgcctggagggcgtgtaccgcaacaacatcgatgacgtggtccgcttcctggactccaagcacaagaaccactacaagatctacaacctgtgcgctgaacgccactacgataccgccaagttcaactgccgcgtcgcacagtacccattcgaggaccacaacccaccacagctggaactgatcaagccattctgcgaggatctggaccagtggctgtccgaagatgacaaccacgttgcagctatccactgcaaggctggcaagggccgcaccggtgtgatgatctgcgcctacctgctgcaccgcggcaagttcctgaaggctcaggaagccctggatttctacggtgaggttcgcacccgcgacaagaagggcgtgaccatcccatcccagcgccgctacgtgtactactactcctacctgctgaagaaccacctggattaccgcccagtcgctctgctgttccacaagatgatgttcgaaaccatcccaatgttctccggtggcacctgcaacccacagttcgttgtgtgccagctgaaggtcaagatctactcctccaactccggtccaacccgtcgcgaggataagttcatgtacttcgagttcccacagccactgccagtgtgcggcgacatcaaggtcgaattcttccacaagcagaacaagatgctgaagaaggataagatgttccacttctgggtcaacaccttcttcatcccaggtccagaagaaacctctgaaaaggttgagaacggctccctgtgcgatcaggagatcgactccatctgctccatcgaacgcgcagataacgacaaggagtacctggttctgaccctgaccaagaacgatctggacaaggccaacaaggacaaggcaaaccgctacttctccccaaacttcaaggtcaagctgtacttcaccaagaccgttgaagagccatccaacccagaagcttcctcctccacctctgtgaccccagatgtttccgacaacgagccagatcactaccgctactccgataccaccgactccgacccagagaacgagccattcgatgaagaccagcacacccagattaccaaagtttag

SEQ ID NO: 43 - DNA, 1785 bp, Artificial Sequence
  Description of Artificial Sequence: Synthetic polynucleotide
atgaacaataacgatctctttcaggcatcacgtcggcgttttctggcacaactcggcggcttaaccgtcgccgggatgctggggccgtcattgttaacgccgcgacgtgcgactgcgtccgagtctcctgtgaccatctctcgcgctggcaacgctggcgagctggtctctcctctgctgcttcctcctacccgtcgtcgtcgtcgtcgccacatccagggtccaggcccagtgctgaacctgccatccgcagctgctgcaccaccagttgcacgcgcaccagaagctgccggcggtggctcccgctccgaggactactcctcctccccacactccgcagctgctgcagctcgcccactggcagcagaagagaagcaggcacagtccctgcagccatcctcctcccgccgctcctcccactacccagctgctgttcagtcccaggcagctgctgaacgcggtgcttccgcaaccgcaaagtcccgtgcaatctccatcctgcagaagaagccacgccaccagcagctgctgccatccctgtcctccttcttcttctcccaccgcctgccagacatgaccgctatcatcaaggaaatcgtttcccgcaacaagcgccgctaccaggaagatggcttcgatctggacctgacctacatctacccaaacatcatcgcaatgggtttcccagctgaacgcctggagggcgtgtaccgcaacaacatcgatgacgtggtccgcttcctggactccaagcacaagaaccactacaagatctacaacctgtgcgctgaacgccactacgataccgccaagttcaactgccgcgtcgcacagtacccattcgaggaccacaacccaccacagctggaactgatcaagccattctgcgaggatctggaccagtggctgtccgaagatgacaaccacgttgcagctatccactgcaaggctggcaagggccgcaccggtgtgatgatctgcgcctacctgctgcaccgcggcaagttcctgaaggctcaggaagccctggatttctacggtgaggttcgcacccgcgacaagaagggcgtgaccatcccatcccagcgccgctacgtgtactactactcctacctgctgaagaaccacctggattaccgcccagtcgctctgctgttccacaagatgatgttcgaaaccatcccaatgttctccggtggcacctgcaacccacagttcgttgtgtgccagctgaaggtcaagatctactcctccaactccggtccaacccgtcgcgaggataagttcatgtacttcgagttcccacagccactgccagtgtgcggcgacatcaaggtcgaattcttccacaagcagaacaagatgctgaagaaggataagatgttccacttctgggtcaacaccttcttcatcccaggtccagaagaaacctctgaaaaggttgagaacggctccctgtgcgatcaggagatcgactccatctgctccatcgaacgcgcagataacgacaaggagtacctggttctgaccctgaccaagaacgatctggacaaggccaacaaggacaaggcaaaccgctacttctccccaaacttcaaggtcaagctgtacttcaccaagaccgttgaagagccatccaacccagaagcttcctcctccacctctgtgaccccagatgtttccgacaacgagccagatcactaccgctactccgataccaccgactccgaccctgagaacgagccattcgatgaagaccagcacacccagattaccaaagtttag

SEQ ID NO: 44 - DNA, 1761 bp, Artificial Sequence
  Description of Artificial Sequence: Synthetic polynucleotide
atgaaattatcgaagcgtggtttattctggctgttaggtttagtctcatttgcgatcttgttgttgttctctcagcccttgggtgctcaagcttcagagtctccagtgacgatttcgcgggcgggtaacgccggtgaattggttagcccgctattgctgccaccgacccgccgacggcgtcggcgtcatattcagggcccaggtccggttttgaacttgccttcagcggcagctgcgcctcccgtcgctcgggcacctgaagccgctgggggcggctcgcgctcagaggattatagtagtagtccccacagtgccgccgctgcggcccgccccctagccgccgaggaaaaacaagcacagtcattacagccttctagttcacgccgtagttctcattacccggcagctgtccaaagccaagcggcggccgagcgtggggcaagcgccactgccaagagccgtgcaatttcgattttacaaaagaaaccacgtcatcaacagttactgccgtcattatctagctttttctttagtcatcggctaccagatatgacagctattattaaagaaattgttagtcgaaataagcggcgctatcaagaagatggtttcgatttagatttaacatacatttatccaaatatcattgcgatgggatttcccgctgagcggttggaaggcgtctatcgaaacaatatcgacgatgttgtccggtttttagattcgaagcataagaatcactacaagatttacaacctgtgtgcagaacggcattatgacactgcgaagtttaattgtcgagttgcacaatatccgtttgaagatcataaccccccacaattagagttaatcaaaccattttgtgaagatttagatcagtggttaagtgaagatgataatcacgtggcggctattcattgtaaggctgggaagggtcgtacaggcgtgatgatttgcgcttacttattacaccgtggaaagtttctaaaagcgcaagaagcattagatttctatggtgaagttcgtacccgagataaaaagggcgtcacgatcccgagtcaacgccgctatgtttactactattcgtacttactaaagaatcacctagattatcgcccagtcgctttgttgttccataagatgatgtttgaaacgattccaatgttttctggtggcacgtgtaacccgcaatttgtagtgtgtcaactaaaagtgaagatatatagttcaaatagtgggcccactcgacgggaagataagttcatgtatttcgagtttccacagccattgccagtttgcggagacatcaaagtcgaatttttccacaagcaaaataagatgctgaaaaaagataaaatgtttcacttttgggtaaacactttctttattccaggaccagaagaaacctctgaaaaagtcgaaaatggttcgttatgcgatcaagaaattgattcgatttgtagtattgaacgtgcggacaatgacaaagaatatctggtattgactttgacgaaaaatgacttggacaaagccaataaagataaggcaaatcggtacttttcaccgaacttcaaggtcaaattatattttacgaaaactgtggaagaaccatcaaatccagaggcaagctcaagcaccagtgttacacctgacgtcagtgacaacgaacctgatcattatcggtatagcgacaccacggattcagatcctgaaaatgaaccgtttgacgaagatcaacatactcagatcacgaaagtttga

SEQ ID NO: 45 - DNA, 1749 bp, Artificial Sequence
  Description of Artificial Sequence: Synthetic polynucleotide
atgaaagaagtgcgtttctggggtttactattagggttgtttgtctgtttgggtgctgttatccctctggtatctaaagcctcagagtctccagtgacgatttcgcgggcgggtaacgccggtgaattggttagcccgctattgctgccaccgacccgccgacggcgtcggcgtcatattcagggcccaggtccggttttgaacttgccttcagcggcagctgcgcctcccgtcgctcgggcacctgaagccgctgggggcggctcgcgctcagaggattatagtagtagtccccacagtgccgccgctgcggcccgccccctagccgccgaggaaaaacaagcacagtcattacagccttctagttcacgccgtagttctcattacccggcagctgtccaaagccaagcggcggccgagcgtggggcaagcgccactgccaagagccgtgcaatttcgattttacaaaagaaaccacgtcatcaacagttactgccgtcattatctagctttttctttagtcatcggctaccagatatgacagctattattaaagaaattgttagtcgaaataagcggcgctatcaagaagatggtttcgatttagatttaacatacatttatccaaatatcattgcgatgggatttcccgctgagcggttggaaggcgtctatcgaaacaatatcgacgatgttgtccggtttttagattcgaagcataagaatcactacaagatttacaacctgtgtgcagaacggcattatgacactgcgaagtttaattgtcgagttgcacaatatccgtttgaagatcataaccccccacaattagagttaatcaaaccattttgtgaagatttagatcagtggttaagtgaagatgataatcacgtggcggctattcattgtaaggctgggaagggtcgtacaggcgtgatgatttgcgcttacttattacaccgtggaaagtttctaaaagcgcaagaagcattagatttctatggtgaagttcgtacccgagataaaaagggcgtcacgatcccgagtcaacgccgctatgtttactactattcgtacttactaaagaatcacctagattatcgcccagtcgctttgttgttccataagatgatgtttgaaacgattccaatgttttctggtggcacgtgtaacccgcaatttgtagtgtgtcaactaaaagtgaagatatatagttcaaatagtgggcccactcgacgggaagataagttcatgtatttcgagtttccacagccattgccagtttgcggagacatcaaagtcgaatttttccacaagcaaaataagatgctgaaaaaagataaaatgtttcacttttgggtaaacactttctttattccaggaccagaagaaacctctgaaaaagtcgaaaatggttcgttatgcgatcaagaaattgattcgatttgtagtattgaacgtgcggacaatgacaaagaatatctggtattgactttgacgaaaaatgacttggacaaagccaataaagataaggcaaatcggtacttttcaccgaacttcaaggtcaaattatattttacgaaaactgtggaagaaccatcaaatccagaggcaagctcaagcaccagtgttacacctgacgtcagtgacaacgaacctgatcattatcggtatagcgacaccacggattcagatcctgaaaatgaaccgtttgacgaagatcaacatactcagatcacgaaagtttga

SEQ ID NO: 46 - DNA, 3741 bp, Artificial Sequence
  Description of Artificial Sequence: Synthetic polynucleotide
atgagattcccatctattttcaccgctgtcttgttcgctgcctcctctgcattggctgcccctgttaacactaccactgaagacgagactgctcaaattccagctgaagcagttatcggttactctgaccttgagggtgatttcgacgtcgctgttttgcctttctctaactccactaacaacggtttgttgttcattaacaccactatcgcttccattgctgctaaggaagagggtgtctctctcgagaaaagagatgctcataaatcagaggttgcacataggtttaaagatttgggtgaggaaaatttcaaggctctagttttgattgcatttgcacaatacctacagcaatgtccatttgaagatcacgtaaaattggtcaatgaagtcacagagtttgcaaagacatgcgtcgccgacgagagtgcagagaattgtgacaaatccttgcataccctttttggtgataagctatgtacagttgctacattgcgtgagacatatggtgagatggctgattgttgtgcaaagcaagagcccgaaaggaacgaatgtttcttgcaacataaagatgataatccaaatctgcctagattggtcagacctgaagtggacgtcatgtgtaccgctttccacgataacgaagagactttcttgaaaaagtacttgtatgaaatcgctagacgtcatccttacttctatgcaccagaattgcttttcttcgctaagcgatacaaagctgctttcactgagtgttgtcaggccgcagacaaagcagcttgtctgttacctaagctcgacgaattgcgtgacgagggtaaggcaagctccgctaaacaaagactgaagtgcgctagcttgcagaagtttggagaaagagcttttaaggcctgggctgtggcacgactgtcacaacgttttcctaaggctgagttcgctgaggtttcaaaactagttacagatttgacaaaagtgcacacagaatgctgtcatggtgatttactggaatgtgcagacgatcgcgctgatctggcaaagtacatttgcgaaaaccaggattcaatctcttccaaattaaaggaatgctgtgaaaaacctttgttggaaaaaagtcattgtatcgctgaagtggaaaatgacgaaatgcctgccgatctgccttccttagctgccgacttcgtagaatcgaaagacgtatgtaaaaattacgccgaagctaaagacgtgtttctaggtatgtttttgtacgagtatgctagaaggcaccctgattactcagtagtccttttgctgagacttgctaaaacgtatgaaacgacgctggaaaaatgttgtgctgctgccgatccacatgagtgttacgcaaaagtttttgatgaattcaaacctctggttgaggaacctcaaaacttgattaagcaaaattgcgagctttttgaacaacttggtgaatataaattccagaatgcattgttggtaagatataccaaaaaagttccacaggtgtccactccaacattggttgaagtttcccgtaacttgggtaaggtgggttcgaagtgctgcaagcatcctgaagctaagagaatgccttgcgctgaggactatctatccgtcgttcttaaccaattatgtgttttgcacgaaaagactcccgtgagtgacagagttactaaatgttgtactgaatcattagttaacagacgtccatgtttctctgcgctcgaagttgacgagacatacgtacccaaggaattcaacgccgagacttttacttttcatgctgacatttgcacactgtcggaaaaggaacgtcagatcaaaaagcaaacagctttggtcgaacttgtgaagcataagccaaaagcaactaaagagcaattgaaagctgttatggacgattttgctgcatttgtggagaagtgttgcaaggctgatgacaaagagacatgtttcgctgaagagggtaaaaaactagtggccgcttctcaagcagctctgggtttgggcccagcagcattaaaggctgccactaatcgtaggaaaaagagagccttggatgcagcttatatctccagagccggaaatgccggtgaattagtttccccactgttgttgccgcccactcgtagacgtaggcgtagacatatccagggaccaggaccagtgctgaatttaccttcagctgctgctgctccgccggtagctagggccccagaagcggcaggaggtggttctaggtccgaggattactctagctctccacattcggctgctgccgccgcaagacctttagcagcagaagagaagcaagcacaatctttgcaaccttcctcctctagaagatcaagccattatcctgctgctgtccagagtcaggcagctgctgagaggggtgcctctgctactgccaaatctagagctatatctatcttgcagaaaaagcctagacaccaacaactccttccatccctgtcgagtttcttcttctctcacaggctcccagatatgactgccattatcaaggagatcgtcagtcgtaacaagagaagataccaagaggacggcttcgacctggatcttacatatatttacccaaacatcatagctatggggttccccgcagaaagattggaaggtgtctatagaaataatattgacgacgttgttagatttctagatagcaaacataaaaatcactacaagatatacaacctctgtgctgaaagacactacgacactgctaagttcaattgtagagtagcacagtaccccttcgaggatcataatcctccacaacttgagttgatcaaacctttttgtgaggacttggaccaatggctgtcagaggacgataatcacgtcgcagctattcattgtaaggctggaaaaggtcgaacaggagtcatgatttgtgcttatctactgcacagaggtaagtttctaaaagctcaagaggctttggatttttatggtgaagttaggactagagacaaaaagggtgttaccatccccagccagagaaggtacgtatattattacagttatctgttgaaaaaccacttagactaccgtcccgttgcactgttattccacaagatgatgtttgaaacgatcccaatgttctctggtggaacttgtaaccctcaattcgttgtttgccagttaaaggttaaaatttatagctccaattcaggacccacaagacgggaagataaatttatgtactttgaatttccacaaccattgccagtctgtggtgatattaaggtagagtttttccataagcaaaacaaaatgttgaaaaaagacaaaatgttccacttctgggtgaataccttcttcattcctggaccagaggaaacgtccgaaaaagttgaaaacggctcattgtgtgatcaagagattgactccatctgttcaatcgagcgtgcagacaatgataaagagtacttggtgcttacattgaccaaaaatgatctggataaggctaacaaagacaaagccaatagatatttctcaccaaattttaaagttaagttgtatttcaccaagactgttgaggagccttccaatccagaagcatccagcagtacttcagttactccagacgtatctgacaatgagcctgaccattatcgttactctgatactactgactccgatcctgaaaacgaaccatttgatgaggaccagcacacccaaattacaaaagttcatcaccatcatcatcactag

SEQ ID NO: 47 - DNA, 1842 bp, Artificial Sequence
  Description of Artificial Sequence: Synthetic polynucleotide
atgagatttccttcaatttttactgctgttttattcgcagcatcctccgcattagctgctccagtcaacactacaacagaagatgaattagaaggggatttcgatgttgctgttttgccattttccgccagcattgctgctaaagaagaaggggtatctctcgagaaaagaatgtctgagtcgccagtgactatctccagagccggaaatgccggtgaattagtttccccactgttgttgccgcccactcgtagacgtaggcgtagacatatccagggaccaggaccagtgctgaatttaccttcagctgctgctgctccgccggtagctagggccccagaagcggcaggaggtggttctaggtccgaggattactctagctctccacattcggctgctgccgccgcaagacctttagcagcagaagagaagcaagcacaatctttgcaaccttcctcctctagaagatcaagccattatcctgctgctgtccagagtcaggcagctgctgagaggggtgcctctgctactgccaaatctagagctatatctatcttgcagaaaaagcctagacaccaacaactccttccatccctgtcgagtttcttcttctctcacaggctcccagatatgactgccattatcaaggagatcgtcagtcgtaacaagagaagataccaagaggacggcttcgacctggatcttacatatatttacccaaacatcatagctatggggttccccgcagaaagattggaaggtgtctatagaaataatattgacgacgttgttagatttctagatagcaaacataaaaatcactacaagatatacaacctctgtgctgaaagacactacgacactgctaagttcaattgtagagtagcacagtaccccttcgaggatcataatcctccacaacttgagttgatcaaacctttttgtgaggacttggaccaatggctgtcagaggacgataatcacgtcgcagctattcattgtaaggctggaaaaggtcgaacaggagtcatgatttgtgcttatctactgcacagaggtaagtttctaaaagctcaagaggctttggatttttatggtgaagttaggactagagacaaaaagggtgttaccatccccagccagagaaggtacgtatattattacagttatctgttgaaaaaccacttagactaccgtcccgttgcactgttattccacaagatgatgtttgaaacgatcccaatgttctctggtggaacttgtaaccctcaattcgttgtttgccagttaaaggttaaaatttatagctccaattcaggacccacaagacgggaagataaatttatgtactttgaatttccacaaccattgccagtctgtggtgatattaaggtagagtttttccataagcaaaacaaaatgttgaaaaaagacaaaatgttccacttctgggtgaataccttcttcattcctggaccagaggaaacgtccgaaaaagttgaaaacggctcattgtgtgatcaagagattgactccatctgttcaatcgagcgtgcagacaatgataaagagtacttggtgcttacattgaccaaaaatgatctggataaggctaacaaagacaaagccaatagatatttctcaccaaattttaaagttaagttgtatttcaccaagactgttgaggagccttccaatccagaagcatccagcagtacttcagttactccagacgtatctgacaatgagcctgaccattatcgttactctgatactactgactccgatcctgaaaacgaaccatttgatgaggaccagcacacccaaattacaaaagtttag

SEQ ID NO: 48 - protein, 21 aa, Artificial Sequence
  Description of Artificial Sequence: Synthetic peptide
GPAALKAATNRRKKRALDAAY

SEQ ID NO: 49 - protein, 747 aa, Artificial Sequence
  Description of Artificial Sequence: Synthetic polypeptide
MVKQIESKTAFQEALDAAGDKLVVVDFSATWCGPCKMIKPFFHSLSEKYSNVIFLEVDVDDCQDVASECEVKCMPTFQFFKKGQKVGEFSGANKEKLEATINELVHHHHHHQIFVKTLTGKTITLEVEPSDTIENVKAKIQDKEGIPPDQQRLIFAGKQLEDGRTLSDYNIQKESTLHLVLRLRGENLYFQGSESPVTISRAGNAGELVSPLLLPPTRRRRRRHIQGPGPVLNLPSAAAAPPVARAPEAAGGGSRSEDYSSSPHSAAAAARPLAAEEKQAQSLQPSSSRRSSHYPAAVQSQAAAERGASATAKSRAISILQKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKV

SEQ ID NO: 50 - protein, 1158 aa, Artificial Sequence
  Description of Artificial Sequence: Synthetic polypeptide
MKWVTFISLLFLFSSAYSRGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLISRAGNAGELVSPLLLPPTHIQGPGPVLNLPSAAAAPPVARAPEAAGGGSRSEDYSSSPHSAAAAARPLAAEEKQAQSLQPSSSRRSSHYPAAVQSQAAAERGASATAKSRAISILQKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKVHHHHHH

SEQ ID NO: 51 - protein, 37 aa, Homo sapiens
LPPTRRRRRRHIQGPGPVLNLPSAAAAPPVARAPEAA

SEQ ID NO: 52 - protein, 94 aa, Homo sapiens
GGGSRSEDYSSSPHSAAAAARPLAAEEKQAQSLQPSSSRRSSHYPAAVQSQAAAERGASATAKSRAISILQKKPRHQQLLPSLSSFFFSHRLPD

SEQ ID NO: 53 - protein, 16 aa, Homo sapiens
PPTRRRRRRHIQGPGP

SEQ ID NO: 54 - DNA, 3558 bp, Artificial Sequence
  Description of Artificial Sequence: Synthetic polynucleotide
gaattcccgccgccaccatgaaatgggtcacctttatcagcctgctgttcctgttcagcagcgcctacagcagaggcgtgttcagaagagatgcccacaagagcgaggtggcccacagattcaaggacctgggcgaagagaacttcaaggccctggtgctgatcgccttcgctcagtacctgcagcagtgcccctttgaggaccacgtgaagctggtcaacgaagtgaccgagttcgccaagacctgcgtggccgatgagagcgccgagaactgtgataagagcctgcacaccctgttcggcgacaagctgtgtacagtggccacactgagagaaacctacggcgagatggccgactgctgcgccaagcaagagcccgagagaaacgagtgcttcctgcagcacaaggacgacaaccccaacctgcctagactcgtgcggcctgaagtggacgtgatgtgcaccgccttccacgacaacgaggaaaccttcctgaagaagtacctgtacgagatcgccagacggcacccctacttttacgcccctgagctgctgttcttcgccaagcggtataaggccgccttcaccgagtgttgtcaggccgctgataaggctgcctgcctgctgcctaagctggacgagcttagagatgagggcaaagccagctccgccaagcagagactgaagtgtgccagcctgcagaagttcggcgagagagcctttaaggcctgggccgttgctagactgagccagagatttcccaaggccgagtttgccgaggtgtccaagctcgtgaccgacctgacaaaggtgcacaccgaatgctgccacggcgacctgctggaatgcgccgatgatagagccgacctggccaagtacatctgcgagaaccaggacagcatcagcagcaagctgaaagagtgctgcgagaagccactgctggaaaagagccactgtatcgccgaggtggaaaacgacgagatgcccgccgatctgccttctctggccgccgattttgtggaaagcaaggacgtgtgcaagaactacgccgaggccaaggatgtgttcctgggcatgtttctgtatgagtacgcccgcagacaccccgactactctgttgtgctgctgctgagactggccaaaacctacgagacaaccctggaaaagtgctgtgccgccgctgatcctcacgagtgttacgccaaggtgttcgacgagttcaagcctctggtggaagaaccccagaacctgatcaagcagaactgcgagctgttcgagcagctgggcgagtacaagttccagaacgccctgctcgtgcggtacaccaagaaggtgccccaggtttccacacctacactggttgaggtgtcccggaacctgggcaaagtgggcagcaagtgttgcaagcaccctgaggccaagagaatgccctgcgccgaggattacctgagcgtggtgctgaatcagctgtgcgtgctgcacgagaaaacccctgtgtccgacagagtgaccaagtgctgtaccgagagcctggtcaacagacggccttgctttagcgccctcgaggtggacgagacatacgtgcccaaagagttcaacgccgagacattcaccttccacgccgacatctgtaccctgagcgagaaagagcggcagatcaagaaacagactgccctggtggaactggtcaagcacaagcccaaggccaccaaagaacagctgaaggccgtgatggacgacttcgccgccttcgtggaaaaatgctgcaaggccgacgacaaagagacatgcttcgccgaagagggcaagaaactggtggccgcttctcaggctgctctcggacttacaaaccggcggaaaaagagagccctggacgccgcctatatcagcagagctggaaatgccggcgagctggtgtctcctttgctgctgcctcctaccagacggcggagaaggcggcatatacaaggaccaggacctgtgctgaacctgccatctgctgctgcagctcctcctgtggctagagcacctgaagctgctggcggaggctctagaagcgaggactactctagcagccctcattctgctgccgctgccgctagacctctggctgccgaagaaaaacaggcccagagtctgcagcctagcagctccagaagaagcagccattatcctgccgccgtgcagtcacaggctgcagctgaaaggggagcctctgccacagccaagagcagagccatcagcatcctgcagaaaaagccccggcaccagcaactgctgccaagcctgagcagcttcttcttctctcaccggctgcctgacatgaccgccatcatcaaagaaatcgtgtctcggaacaagcggcgctaccaagaggacggcttcgacctggatctgacctacatctaccccaacatcattgccatgggcttccccgccgaaagactggaaggggtgtaccggaacaacatcgacgatgtcgtgcggttcctggactctaagcacaagaaccactacaagatctacaacctgtgcgccgagcggcactacgacaccgccaagttcaattgcagagtggcccagtatcctttcgaggatcacaaccctccacagctcgaactgattaagcccttctgcgaggacctggaccagtggctgagcgaggacgataatcacgtggccgccatccactgcaaagccggcaagggaagaaccggcgtgatgatctgtgcttacctgctgcaccggggcaagtttctgaaggcccaagaggctctggacttctacggcgaagtgcggaccagagacaagaaaggcgtgacaatccccagccagcggagatacgtgtactactacagctacctgctgaagaaccacctggactacagacccgtcgctctgctgtttcacaagatgatgttcgagactatccccatgttctccggcggcacctgtaatccccagttcgtcgtgtgtcagctcaaagtgaagatctactccagcaacagcggccccaccagacgcgaggataagttcatgtacttcgagttcccacagccactgcctgtgtgcggcgatatcaaggtggaatttttccataagcagaacaagatgctgaaaaaggacaagatgttccacttctgggtcaacaccttcttcatccccggacctgaagagacaagcgagaaggtcgagaacggctccctgtgcgaccaagagatcgacagcatctgctccatcgagcgggccgacaatgacaaagaatacctggtgctcaccctgaccaagaacgatctggacaaggccaacaaggataaggccaaccggtacttcagccccaacttcaaagtcaagctgtacttcaccaagaccgtcgaggaacccagcaatccagaggccagctctagcacctctgtgacccctgacgtgtccgataacgagcccgaccactacagatacagcgacaccaccgacagcgaccccgagaacgagccttttgatgaggaccagcacacccagatcaccaaggtgcaccaccaccatcaccactgataagctt

SEQ ID NO: 55 - DNA, 3543 bp, Artificial Sequence
  Description of Artificial Sequence: Synthetic polynucleotide
gaattcccgccgccaccatgaaatgggtcacctttatcagcctgctgttcctgttcagcagcgcctacagcagaggcgtgttcagaagagatgcccacaagagcgaggtggcccacagattcaaggacctgggcgaagagaacttcaaggccctggtgctgatcgccttcgctcagtacctgcagcagtgcccctttgaggaccacgtgaagctggtcaacgaagtgaccgagttcgccaagacctgcgtggccgatgagagcgccgagaactgtgataagagcctgcacaccctgttcggcgacaagctgtgtacagtggccacactgagagaaacctacggcgagatggccgactgctgcgccaagcaagagcccgagagaaacgagtgcttcctgcagcacaaggacgacaaccccaacctgcctagactcgtgcggcctgaagtggacgtgatgtgcaccgccttccacgacaacgaggaaaccttcctgaagaagtacctgtacgagatcgccagacggcacccctacttttacgcccctgagctgctgttcttcgccaagcggtataaggccgccttcaccgagtgttgtcaggccgctgataaggctgcctgcctgctgcctaagctggacgagcttagagatgagggcaaagccagctccgccaagcagagactgaagtgtgccagcctgcagaagttcggcgagagagcctttaaggcctgggccgttgctagactgagccagagatttcccaaggccgagtttgccgaggtgtccaagctcgtgaccgacctgacaaaggtgcacaccgaatgctgccacggcgacctgctggaatgcgccgatgatagagccgacctggccaagtacatctgcgagaaccaggacagcatcagcagcaagctgaaagagtgctgcgagaagccactgctggaaaagagccactgtatcgccgaggtggaaaacgacgagatgcccgccgatctgccttctctggccgccgattttgtggaaagcaaggacgtgtgcaagaactacgccgaggccaaggatgtgttcctgggcatgtttctgtatgagtacgcccgcagacaccccgactactctgttgtgctgctgctgagactggccaaaacctacgagacaaccctggaaaagtgctgtgccgccgctgatcctcacgagtgttacgccaaggtgttcgacgagttcaagcctctggtggaagaaccccagaacctgatcaagcagaactgcgagctgttcgagcagctgggcgagtacaagttccagaacgccctgctcgtgcggtacaccaagaaggtgccccaggtttccacacctacactggttgaggtgtcccggaacctgggcaaagtgggcagcaagtgttgcaagcaccctgaggccaagagaatgccctgcgccgaggattacctgagcgtggtgctgaatcagctgtgcgtgctgcacgagaaaacccctgtgtccgacagagtgaccaagtgctgtaccgagagcctggtcaacagacggccttgctttagcgccctcgaggtggacgagacatacgtgcccaaagagttcaacgccgagacattcaccttccacgccgacatctgtaccctgagcgagaaagagcggcagatcaagaaacagactgccctggtggaactggtcaagcacaagcccaaggccaccaaagaacagctgaaggccgtgatggacgacttcgccgccttcgtggaaaaatgctgcaaggccgacgacaaagagacatgcttcgccgaagagggcaagaaactggtggccgcttctcaggctgctctcggacttggacctgctgctctgaaagccgccatcagcagagctggaaatgccggcgagctggtgtctcctttgctgctgcctcctaccagacggcggagaaggcggcatatacaaggaccaggacctgtgctgaacctgccatctgctgctgcagctcctcctgtggctagagcacctgaagctgctggcggaggctctagaagcgaggactactctagcagccctcattctgctgccgctgccgctagacctctggctgccgaagaaaaacaggcccagagtctgcagcctagcagctccagaagaagcagccattatcctgccgccgtgcagtcacaggctgcagctgaaaggggagcctctgccacagccaagagcagagccatcagcatcctgcagaaaaagccccggcaccagcaactgctgccaagcctgagcagcttcttcttctctcaccggctgcctgacatgaccgccatcatcaaagaaatcgtgtctcggaacaagcggcgctaccaagaggacggcttcgacctggatctgacctacatctaccccaacatcattgccatgggcttccccgccgaaagactggaaggggtgtaccggaacaacatcgacgatgtcgtgcggttcctggactctaagcacaagaaccactacaagatctacaacctgtgcgccgagcggcactacgacaccgccaagttcaattgcagagtggcccagtatcctttcgaggatcacaaccctccacagctcgaactgattaagcccttctgcgaggacctggaccagtggctgagcgaggacgataatcacgtggccgccatccactgcaaagccggcaagggaagaaccggcgtgatgatctgtgcttacctgctgcaccggggcaagtttctgaaggcccaagaggctctggacttctacggcgaagtgcggaccagagacaagaaaggcgtgacaatccccagccagcggagatacgtgtactactacagctacctgctgaagaaccacctggactacagacccgtcgctctgctgtttcacaagatgatgttcgagactatccccatgttctccggcggcacctgtaatccccagttcgtcgtgtgtcagctcaaagtgaagatctactccagcaacagcggccccaccagacgcgaggataagttcatgtacttcgagttcccacagccactgcctgtgtgcggcgatatcaaggtggaatttttccataagcagaacaagatgctgaaaaaggacaagatgttccacttctgggtcaacaccttcttcatccccggacctgaagagacaagcgagaaggtcgagaacggctccctgtgcgaccaagagatcgacagcatctgctccatcgagcgggccgacaatgacaaagaatacctggtgctcaccctgaccaagaacgatctggacaaggccaacaaggataaggccaaccggtacttcagccccaacttcaaagtcaagctgtacttcaccaagaccgtcgaggaacccagcaatccagaggccagctctagcacctctgtgacccctgacgtgtccgataacgagcccgaccactacagatacagcgacaccaccgacagcgaccccgagaacgagccttttgatgaggaccagcacacccagatcaccaaggtgcaccaccaccatcaccactgataagctt

SEQ ID NO: 56 - DNA, 3519 bp, Artificial Sequence
  Description of Artificial Sequence: Synthetic polynucleotide
gaattcccgccgccaccatgaaatgggtcacctttatcagcctgctgttcctgttcagcagcgcctacagcagaggcgtgttcagaagagatgcccacaagagcgaggtggcccacagattcaaggacctgggcgaagagaacttcaaggccctggtgctgatcgccttcgctcagtacctgcagcagtgcccctttgaggaccacgtgaagctggtcaacgaagtgaccgagttcgccaagacctgcgtggccgatgagagcgccgagaactgtgataagagcctgcacaccctgttcggcgacaagctgtgtacagtggccacactgagagaaacctacggcgagatggccgactgctgcgccaagcaagagcccgagagaaacgagtgcttcctgcagcacaaggacgacaaccccaacctgcctagactcgtgcggcctgaagtggacgtgatgtgcaccgccttccacgacaacgaggaaaccttcctgaagaagtacctgtacgagatcgccagacggcacccctacttttacgcccctgagctgctgttcttcgccaagcggtataaggccgccttcaccgagtgttgtcaggccgctgataaggctgcctgcctgctgcctaagctggacgagcttagagatgagggcaaagccagctccgccaagcagagactgaagtgtgccagcctgcagaagttcggcgagagagcctttaaggcctgggccgttgctagactgagccagagatttcccaaggccgagtttgccgaggtgtccaagctcgtgaccgacctgacaaaggtgcacaccgaatgctgccacggcgacctgctggaatgcgccgatgatagagccgacctggccaagtacatctgcgagaaccaggacagcatcagcagcaagctgaaagagtgctgcgagaagccactgctggaaaagagccactgtatcgccgaggtggaaaacgacgagatgcccgccgatctgccttctctggccgccgattttgtggaaagcaaggacgtgtgcaagaactacgccgaggccaaggatgtgttcctgggcatgtttctgtatgagtacgcccgcagacaccccgactactctgttgtgctgctgctgagactggccaaaacctacgagacaaccctggaaaagtgctgtgccgccgctgatcctcacgagtgttacgccaaggtgttcgacgagttcaagcctctggtggaagaaccccagaacctgatcaagcagaactgcgagctgttcgagcagctgggcgagtacaagttccagaacgccctgctcgtgcggtacaccaagaaggtgccccaggtttccacacctacactggttgaggtgtcccggaacctgggcaaagtgggcagcaagtgttgcaagcaccctgaggccaagagaatgccctgcgccgaggattacctgagcgtggtgctgaatcagctgtgcgtgctgcacgagaaaacccctgtgtccgacagagtgaccaagtgctgtaccgagagcctggtcaacagacggccttgctttagcgccctcgaggtggacgagacatacgtgcccaaagagttcaacgccgagacattcaccttccacgccgacatctgtaccctgagcgagaaagagcggcagatcaagaaacagactgccctggtggaactggtcaagcacaagcccaaggccaccaaagaacagctgaaggccgtgatggacgacttcgccgccttcgtggaaaaatgctgcaaggccgacgacaaagagacatgcttcgccgaagagggcaagaaactggtggccgcttctcaggctgctctcggacttatcagcagagctggaaatgccggcgagctggtgtctcctttgctgctgcctcctaccagacggcggagaaggcggcatatacaaggaccaggacctgtgctgaacctgccatctgctgctgcagctcctcctgtggctagagcacctgaagctgctggcggaggctctagaagcgaggactactctagcagccctcattctgctgccgctgccgctagacctctggctgccgaagaaaaacaggcccagagtctgcagcctagcagctccagaagaagcagccattatcctgccgccgtgcagtcacaggctgcagctgaaaggggagcctctgccacagccaagagcagagccatcagcatcctgcagaaaaagccccggcaccagcaactgctgccaagcctgagcagcttcttcttctctcaccggctgcctgacatgaccgccatcatcaaagaaatcgtgtctcggaacaagcggcgctaccaagaggacggcttcgacctggatctgacctacatctaccccaacatcattgccatgggcttccccgccgaaagactggaaggggtgtaccggaacaacatcgacgatgtcgtgcggttcctggactctaagcacaagaaccactacaagatctacaacctgtgcgccgagcggcactacgacaccgccaagttcaattgcagagtggcccagtatcctttcgaggatcacaaccctccacagctcgaactgattaagcccttctgcgaggacctggaccagtggctgagcgaggacgataatcacgtggccgccatccactgcaaagccggcaagggaagaaccggcgtgatgatctgtgcttacctgctgcaccggggcaagtttctgaaggcccaagaggctctggacttctacggcgaagtgcggaccagagacaagaaaggcgtgacaatccccagccagcggagatacgtgtactactacagctacctgctgaagaaccacctggactacagacccgtcgctctgctgtttcacaagatgatgttcgagactatccccatgttctccggcggcacctgtaatccccagttcgtcgtgtgtcagctcaaagtgaagatctactccagcaacagcggccccaccagacgcgaggataagttcatgtacttcgagttcccacagccactgcctgtgtgcggcgatatcaaggtggaatttttccataagcagaacaagatgctgaaaaaggacaagatgttccacttctgggtcaacaccttcttcatccccggacctgaagagacaagcgagaaggtcgagaacggctccctgtgcgaccaagagatcgacagcatctgctccatcgagcgggccgacaatgacaaagaatacctggtgctcaccctgaccaagaacgatctggacaaggccaacaaggataaggccaaccggtacttcagccccaacttcaaagtcaagctgtacttcaccaagaccgtcgaggaacccagcaatccagaggccagctctagcacctctgtgacccctgacgtgtccgataacgagcccgaccactacagatacagcgacaccaccgacagcgaccccgagaacgagccttttgatgaggaccagcacacccagatcaccaaggtgcaccaccaccatcaccactgataagctt

SEQ ID NO: 57 - DNA, 3582 bp, Artificial Sequence
  Description of Artificial Sequence: Synthetic polynucleotide
gaattcccgccgccaccatgaaatgggtcacctttatcagcctgctgttcctgttcagcagcgcctacagcagaggcgtgttcagaagagatgcccacaagagcgaggtggcccacagattcaaggacctgggcgaagagaacttcaaggccctggtgctgatcgccttcgctcagtacctgcagcagtgcccctttgaggaccacgtgaagctggtcaacgaagtgaccgagttcgccaagacctgcgtggccgatgagagcgccgagaactgtgataagagcctgcacaccctgttcggcgacaagctgtgtacagtggccacactgagagaaacctacggcgagatggccgactgctgcgccaagcaagagcccgagagaaacgagtgcttcctgcagcacaaggacgacaaccccaacctgcctagactcgtgcggcctgaagtggacgtgatgtgcaccgccttccacgacaacgaggaaaccttcctgaagaagtacctgtacgagatcgccagacggcacccctacttttacgcccctgagctgctgttcttcgccaagcggtataaggccgccttcaccgagtgttgtcaggccgctgataaggctgcctgcctgctgcctaagctggacgagcttagagatgagggcaaagccagctccgccaagcagagactgaagtgtgccagcctgcagaagttcggcgagagagcctttaaggcctgggccgttgctagactgagccagagatttcccaaggccgagtttgccgaggtgtccaagctcgtgaccgacctgacaaaggtgcacaccgaatgctgccacggcgacctgctggaatgcgccgatgatagagccgacctggccaagtacatctgcgagaaccaggacagcatcagcagcaagctgaaagagtgctgcgagaagccactgctggaaaagagccactgtatcgccgaggtggaaaacgacgagatgcccgccgatctgccttctctggccgccgattttgtggaaagcaaggacgtgtgcaagaactacgccgaggccaaggatgtgttcctgggcatgtttctgtatgagtacgcccgcagacaccccgactactctgttgtgctgctgctgagactggccaaaacctacgagacaaccctggaaaagtgctgtgccgccgctgatcctcacgagtgttacgccaaggtgttcgacgagttcaagcctctggtggaagaaccccagaacctgatcaagcagaactgcgagctgttcgagcagctgggcgagtacaagttccagaacgccctgctcgtgcggtacaccaagaaggtgccccaggtttccacacctacactggttgaggtgtcccggaacctgggcaaagtgggcagcaagtgttgcaagcaccctgaggccaagagaatgccctgcgccgaggattacctgagcgtggtgctgaatcagctgtgcgtgctgcacgagaaaacccctgtgtccgacagagtgaccaagtgctgtaccgagagcctggtcaacagacggccttgctttagcgccctcgaggtggacgagacatacgtgcccaaagagttcaacgccgagacattcaccttccacgccgacatctgtaccctgagcgagaaagagcggcagatcaagaaacagactgccctggtggaactggtcaagcacaagcccaaggccaccaaagaacagctgaaggccgtgatggacgacttcgccgccttcgtggaaaaatgctgcaaggccgacgacaaagagacatgcttcgccgaagagggcaagaaactggtggccgcttctcaggctgctctcggacttggacctgctgctctgaaagccgccacaaaccggcggaaaaagagagccctggacgccgcctatatcagcagagctggaaatgccggcgagctggtgtctcctttgctgctgcctcctaccagacggcggagaaggcggcatatacaaggaccaggacctgtgctgaacctgccatctgctgctgcagctcctcctgtggctagagcacctgaagctgctggcggaggctctagaagcgaggactactctagcagccctcattctgctgccgctgccgctagacctctggctgccgaagaaaaacaggcccagagtctgcagcctagcagctccagaagaagcagccattatcctgccgccgtgcagtcacaggctgcagctgaaaggggagcctctgccacagccaagagcagagccatcagcatcctgcagaaaaagccccggcaccagcaactgctgccaagcctgagcagcttcttcttctctcaccggctgcctgacatgaccgccatcatcaaagaaatcgtgtctcggaacaagcggcgctaccaagaggacggcttcgacctggatctgacctacatctaccccaacatcattgccatgggcttccccgccgaaagactggaaggggtgtaccggaacaacatcgacgatgtcgtgcggttcctggactctaagcacaagaaccactacaagatctacaacctgtgcgccgagcggcactacgacaccgccaagttcaattgcagagtggcccagtatcctttcgaggatcacaaccctccacagctcgaactgattaagcccttctgcgaggacctggaccagtggctgagcgaggacgataatcacgtggccgccatccactgcaaagccggcaagggaagaaccggcgtgatgatctgtgcttacctgctgcaccggggcaagtttctgaaggcccaagaggctctggacttctacggcgaagtgcggaccagagacaagaaaggcgtgacaatccccagccagcggagatacgtgtactactacagctacctgctgaagaaccacctggactacagacccgtcgctctgctgtttcacaagatgatgttcgagactatccccatgttctccggcggcacctgtaatccccagttcgtcgtgtgtcagctcaaagtgaagatctactccagcaacagcggccccaccagacgcgaggataagttcatgtacttcgagttcccacagccactgcctgtgtgcggcgatatcaaggtggaatttttccataagcagaacaagatgctgaaaaaggacaagatgttccacttctgggtcaacaccttcttcatccccggacctgaagagacaagcgagaaggtcgagaacggctccctgtgcgaccaagagatcgacagcatctgctccatcgagcgggccgacaatgacaaagaatacctggtgctcaccctgaccaagaacgatctggacaaggccaacaaggataaggccaaccggtacttcagccccaacttcaaagtcaagctgtacttcaccaagaccgtcgaggaacccagcaatccagaggccagctctagcacctctgtgacccctgacgtgtccgataacgagcccgaccactacagatacagcgacaccaccgacagcgaccccgagaacgagccttttgatgaggaccagcacacccagatcaccaaggtgcaccaccaccatcaccactgataagctt

SEQ ID NO: 58 - DNA, 3099 bp, Artificial Sequence
  Description of Artificial Sequence: Synthetic polynucleotide
gaattcccgccgccaccatgaaatgggtcacctttatcagcctgctgttcctgttcagcagcgcctacagcagaggcgtgttcagaagagatgcccacaagagcgaggtggcccacagattcaaggacctgggcgaagagaacttcaaggccctggtgctgatcgccttcgctcagtacctgcagcagtgcccctttgaggaccacgtgaagctggtcaacgaagtgaccgagttcgccaagacctgcgtggccgatgagagcgccgagaactgtgataagagcctgcacaccctgttcggcgacaagctgtgtacagtggccacactgagagaaacctacggcgagatggccgactgctgcgccaagcaagagcccgagagaaacgagtgcttcctgcagcacaaggacgacaaccccaacctgcctagactcgtgcggcctgaagtggacgtgatgtgcaccgccttccacgacaacgaggaaaccttcctgaagaagtacctgtacgagatcgccagacggcacccctacttttacgcccctgagctgctgttcttcgccaagcggtataaggccgccttcaccgagtgttgtcaggccgctgataaggctgcctgcctgctgcctaagctggacgagcttagagatgagggcaaagccagctccgccaagcagagactgaagtgtgccagcctgcagaagttcggcgagagagcctttaaggcctgggccgttgctagactgagccagagatttcccaaggccgagtttgccgaggtgtccaagctcgtgaccgacctgacaaaggtgcacaccgaatgctgccacggcgacctgctggaatgcgccgatgatagagccgacctggccaagtacatctgcgagaaccaggacagcatcagcagcaagctgaaagagtgctgcgagaagccactgctggaaaagagccactgtatcgccgaggtggaaaacgacgagatgcccgccgatctgccttctctggccgccgattttgtggaaagcaaggacgtgtgcaagaactacgccgaggccaaggatgtgttcctgggcatgtttctgtatgagtacgcccgcagacaccccgactactctgttgtgctgctgctgagactggccaaaacctacgagacaaccctggaaaagtgctgtgccgccgctgatcctcacgagtgttacgccaaggtgttcgacgagttcaagcctctggtggaagaaccccagaacctgatcaagcagaactgcgagctgttcgagcagctgggcgagtacaagttccagaacgccctgctcgtgcggtacaccaagaaggtgccccaggtttccacacctacactggttgaggtgtcccggaacctgggcaaagtgggcagcaagtgttgcaagcaccctgaggccaagagaatgccctgcgccgaggattacctgagcgtggtgctgaatcagctgtgcgtgctgcacgagaaaacccctgtgtccgacagagtgaccaagtgctgtaccgagagcctggtcaacagacggccttgctttagcgccctcgaggtggacgagacatacgtgcccaaagagttcaacgccgagacattcaccttccacgccgacatctgtaccctgagcgagaaagagcggcagatcaagaaacagactgccctggtggaactggtcaagcacaagcccaaggccaccaaagaacagctgaaggccgtgatggacgacttcgccgccttcgtggaaaaatgctgcaaggccgacgacaaagagacatgcttcgccgaagagggcaagaaactggtggccgcttctcaggctgctctcggacttatgaccgccatcatcaaagaaatcgtgtctcggaacaagcggcgctaccaagaggacggcttcgacctggatctgacctacatctaccccaacatcattgccatgggcttccccgccgaaagactggaaggggtgtaccggaacaacatcgacgatgtcgtgcggttcctggactctaagcacaagaaccactacaagatctacaacctgtgcgccgagcggcactacgacaccgccaagttcaattgcagagtggcccagtatcctttcgaggatcacaaccctccacagctcgaactgattaagcccttctgcgaggacctggaccagtggctgagcgaggacgataatcacgtggccgccatccactgcaaagccggcaagggaagaaccggcgtgatgatctgtgcttacctgctgcaccggggcaagtttctgaaggcccaagaggctctggacttctacggcgaagtgcggaccagagacaagaaaggcgtgacaatccccagccagcggagatacgtgtactactacagctacctgctgaagaaccacctggactacagacccgtcgctctgctgtttcacaagatgatgttcgagactatccccatgttctccggcggcacctgtaatccccagttcgtcgtgtgtcagctcaaagtgaagatctactccagcaacagcggccccaccagacgcgaggataagttcatgtacttcgagttcccacagccactgcctgtgtgcggcgatatcaaggtggaatttttccataagcagaacaagatgctgaaaaaggacaagatgttccacttctgggtcaacaccttcttcatccccggacctgaagagacaagcgagaaggtcgagaacggctccctgtgcgaccaagagatcgacagcatctgctccatcgagcgggccgacaatgacaaagaatacctggtgctcaccctgaccaagaacgatctggacaaggccaacaaggataaggccaaccggtacttcagccccaacttcaaagtcaagctgtacttcaccaagaccgtcgaggaacccagcaatccagaggccagctctagcacctctgtgacccctgacgtgtccgataacgagcccgaccactacagatacagcgacaccaccgacagcgaccccgagaacgagccttttgatgaggaccagcacacccagatcaccaaggtgtacccgtatgacgtgccggattatgcgtgctgataagcttaagctt

SEQ ID NO: 59 - DNA, 3087 bp, Artificial Sequence
  Description of Artificial Sequence: Synthetic polynucleotide
gaattcccgccgccaccatgaagtgggtcacctttattagtctgctgtttctgttttcttccgcttactcacgaggggtctttaggagagatgctcacaaatcagaggtggcccaccggtttaaggacctgggcgaggagaacttcaaggccctggtgctgatcgcctttgcccagtatctgcagcagtgccccttcgaggatcacgtgaagctggtgaatgaggtgaccgagtttgccaagacatgcgtggccgacgagtctgccgagaactgtgataagagcctgcacaccctgttcggcgacaagctgtgcaccgtggccacactgcgggagacatacggcgagatggccgattgctgtgccaagcaggagcccgagagaaatgagtgctttctgcagcacaaggacgataacccaaatctgccaaggctggtgcgccctgaggtggacgtgatgtgcaccgcctttcacgataacgaggagacattcctgaagaagtatctgtacgagatcgcccggagacacccatatttctacgcccccgagctgctgttctttgccaagagatataaggccgcctttaccgagtgctgtcaggcagcagacaaggcagcatgcctgctgcctaagctggacgagctgagggatgagggcaaggccagctccgccaagcagcgcctgaagtgtgccagcctgcagaagtttggcgagagggccttcaaggcctgggcagtggcaaggctgtctcagagatttccaaaggccgagttcgccgaggtgagcaagctggtgaccgatctgacaaaggtgcacaccgagtgctgtcacggcgacctgctggagtgcgcagacgatagagccgatctggccaagtacatctgtgagaaccaggacagcatctctagcaagctgaaggagtgctgtgagaagcccctgctggagaagtcccactgcatcgccgaggtggagaatgacgagatgccagcagatctgccttctctggcagcagacttcgtggagagcaaggacgtgtgcaagaactatgccgaggccaaggacgtgttcctgggcatgttcctgtatgagtacgccaggcgccacccagactattccgtggtgctgctgctgcggctggccaagacctacgagacaaccctggagaagtgctgtgcagcagccgatccccacgagtgctacgcaaaggtgtttgacgagttcaagcctctggtggaggagccacagaacctgatcaagcagaattgtgagctgttcgagcagctgggcgagtataagtttcagaatgccctgctggtgagatacaccaagaaggtgccccaggtgtccacccctacactggtggaggtgtctaggaacctgggcaaggtcggcagcaagtgctgtaagcacccagaggcaaagaggatgccatgcgcagaggactatctgtccgtggtgctgaatcagctgtgcgtgctgcacgagaagaccccagtgtctgatagggtgaccaagtgctgtacagagtccctggtgaatagacggccctgcttctctgccctggaggtggacgagacatacgtgcctaaggagtttaacgccgagacattcaccttccacgccgatatctgtaccctgagcgagaaggagcgccagatcaagaagcagacagccctggtggagctggtgaagcacaagcccaaggccaccaaggagcagctgaaggccgtgatggacgattttgccgccttcgtggagaagtgctgtaaggccgacgataaggagacatgcttcgcagaggagggcaagaagctggtggcagcatcccaggccgccctgggcctgatgaccgccatcatcaaggagatcgtgagccgcaataagaggcgctatcaggaggatggcttcgacctggatctgacatatatctacccaaacatcatcgccatgggatttccagcagagaggctggagggcgtgtacaggaacaatatcgacgatgtggtgaggttcctggactccaagcacaagaaccactataagatctacaatctgtgcgccgagcggcactatgataccgccaagttcaactgtagagtggcccagtacccatttgaggaccacaatccaccccagctggagctgatcaagcccttttgcgaggacctggatcagtggctgagcgaggacgataatcacgtggcagcaatccactgcaaggcaggcaagggaaggacaggcgtgatgatctgtgcctatctgctgcacaggggcaagttcctgaaggcccaggaggccctggacttttacggcgaggtgcggaccagagataagaagggcgtgacaatccctagccagcggcggtacgtgtactattactcctacctgctgaagaaccacctggactaccgcccagtggccctgctgtttcacaagatgatgttcgagacaatccctatgttctccggcggcacatgcaacccacagtttgtggtgtgccagctgaaggtgaagatctatagctccaattctggccccaccaggcgcgaggataagttcatgtactttgagttcccccagcctctgccagtgtgcggcgacatcaaggtggagtttttccacaagcagaacaagatgctgaagaaggataagatgtttcacttctgggtgaatacctttttcatccccggccctgaggagacaagcgagaaggtggagaatggctccctgtgcgaccaggagatcgattctatctgtagcatcgagagggccgacaacgataaggagtacctggtgctgaccctgacaaagaatgacctggataaggccaacaaggacaaggccaatcgctatttttctcccaacttcaaggtgaagctgtacttcaccaagacagtggaggagcctagcaatccagaggcctctagctccaccagcgtgacacccgacgtgtccgataacgagcctgaccactatcggtactccgataccacagactctgatcctgagaacgagccatttgacgaagaccagcatactcagattactaaagtccaccatcatcaccaccactaataagcttggatcc

SEQ ID NO: 60 - DNA, 3126 bp, Artificial Sequence
  Description of Artificial Sequence: Synthetic polynucleotide
gaattcccgccgccaccatgaagtgggtcacctttattagtctgctgtttctgttttcttccgcttactcacgaggggtctttaggagagatgctcacaaatcagaggtggcccaccggtttaaggacctgggcgaggagaacttcaaggccctggtgctgatcgcctttgcccagtatctgcagcagtgccccttcgaggatcacgtgaagctggtgaatgaggtgaccgagtttgccaagacatgcgtggccgacgagtctgccgagaactgtgataagagcctgcacaccctgttcggcgacaagctgtgcaccgtggccacactgcgggagacatacggcgagatggccgattgctgtgccaagcaggagcccgagagaaatgagtgctttctgcagcacaaggacgataacccaaatctgccaaggctggtgcgccctgaggtggacgtgatgtgcaccgcctttcacgataacgaggagacattcctgaagaagtatctgtacgagatcgcccggagacacccatatttctacgcccccgagctgctgttctttgccaagagatataaggccgcctttaccgagtgctgtcaggcagcagacaaggcagcatgcctgctgcctaagctggacgagctgagggatgagggcaaggccagctccgccaagcagcgcctgaagtgtgccagcctgcagaagtttggcgagagggccttcaaggcctgggcagtggcaaggctgtctcagagatttccaaaggccgagttcgccgaggtgagcaagctggtgaccgatctgacaaaggtgcacaccgagtgctgtcacggcgacctgctggagtgcgcagacgatagagccgatctggccaagtacatctgtgagaaccaggacagcatctctagcaagctgaaggagtgctgtgagaagcccctgctggagaagtcccactgcatcgccgaggtggagaatgacgagatgccagcagatctgccttctctggcagcagacttcgtggagagcaaggacgtgtgcaagaactatgccgaggccaaggacgtgttcctgggcatgttcctgtatgagtacgccaggcgccacccagactattccgtggtgctgctgctgcggctggccaagacctacgagacaaccctggagaagtgctgtgcagcagccgatccccacgagtgctacgcaaaggtgtttgacgagttcaagcctctggtggaggagccacagaacctgatcaagcagaattgtgagctgttcgagcagctgggcgagtataagtttcagaatgccctgctggtgagatacaccaagaaggtgccccaggtgtccacccctacactggtggaggtgtctaggaacctgggcaaggtcggcagcaagtgctgtaagcacccagaggcaaagaggatgccatgcgcagaggactatctgtccgtggtgctgaatcagctgtgcgtgctgcacgagaagaccccagtgtctgatagggtgaccaagtgctgtacagagtccctggtgaatagacggccctgcttctctgccctggaggtggacgagacatacgtgcctaaggagtttaacgccgagacattcaccttccacgccgatatctgtaccctgagcgagaaggagcgccagatcaagaagcagacagccctggtggagctggtgaagcacaagcccaaggccaccaaggagcagctgaaggccgtgatggacgattttgccgccttcgtggagaagtgctgtaaggccgacgataaggagacatgcttcgcagaggagggcaagaagctggtggcagcatcccaggccgccctgggcctgaccaacaggcgcaagaagcgggccctggacgcagcatacatgaccgccatcatcaaggagatcgtgagccgcaataagaggcgctatcaggaggatggcttcgacctggatctgacatatatctacccaaacatcatcgccatgggatttccagcagagaggctggagggcgtgtacaggaacaatatcgacgatgtggtgaggttcctggactccaagcacaagaaccactataagatctacaatctgtgcgccgagcggcactatgataccgccaagttcaactgtagagtggcccagtacccatttgaggaccacaatccaccccagctggagctgatcaagcccttttgcgaggacctggatcagtggctgagcgaggacgataatcacgtggcagcaatccactgcaaggcaggcaagggaaggacaggcgtgatgatctgtgcctatctgctgcacaggggcaagttcctgaaggcccaggaggccctggacttttacggcgaggtgcggaccagagataagaagggcgtgacaatccctagccagcggcggtacgtgtactattactcctacctgctgaagaaccacctggactaccgcccagtggccctgctgtttcacaagatgatgttcgagacaatccctatgttctccggcggcacatgcaacccacagtttgtggtgtgccagctgaaggtgaagatctatagctccaattctggccccaccaggcgcgaggataagttcatgtactttgagttcccccagcctctgccagtgtgcggcgacatcaaggtggagtttttccacaagcagaacaagatgctgaagaaggataagatgtttcacttctgggtgaatacctttttcatccccggccctgaggagacaagcgagaaggtggagaatggctccctgtgcgaccaggagatcgattctatctgtagcatcgagagggccgacaacgataaggagtacctggtgctgaccctgacaaagaatgacctggataaggccaacaaggacaaggccaatcgctatttttctcccaacttcaaggtgaagctgtacttcaccaagacagtggaggagcctagcaatccagaggcctctagctccaccagcgtgacacccgacgtgtccgataacgagcctgaccactatcggtactccgataccacagactctgatcctgagaacgagccatttgacgaagaccagcatactcagattactaaagtccaccatcatcaccaccactaataagcttggatcc

SEQ ID NO: 61 - DNA, 3204 bp, Artificial Sequence
  Description of Artificial Sequence: Synthetic polynucleotide
gaattcccgccgccaccatgaagtgggtcacctttattagtctgctgtttctgttttcttccgcttactcacgaggggtctttaggagagatgctcacaaatcagaggtggcccaccggtttaaggacctgggcgaggagaacttcaaggccctggtgctgatcgcctttgcccagtatctgcagcagtgccccttcgaggatcacgtgaagctggtgaatgaggtgaccgagtttgccaagacatgcgtggccgacgagtctgccgagaactgtgataagagcctgcacaccctgttcggcgacaagctgtgcaccgtggccacactgcgggagacatacggcgagatggccgattgctgtgccaagcaggagcccgagagaaatgagtgctttctgcagcacaaggacgataacccaaatctgccaaggctggtgcgccctgaggtggacgtgatgtgcaccgcctttcacgataacgaggagacattcctgaagaagtatctgtacgagatcgcccggagacacccatatttctacgcccccgagctgctgttctttgccaagagatataaggccgcctttaccgagtgctgtcaggcagcagacaaggcagcatgcctgctgcctaagctggacgagctgagggatgagggcaaggccagctccgccaagcagcgcctgaagtgtgccagcctgcagaagtttggcgagagggccttcaaggcctgggcagtggcaaggctgtctcagagatttccaaaggccgagttcgccgaggtgagcaagctggtgaccgatctgacaaaggtgcacaccgagtgctgtcacggcgacctgctggagtgcgcagacgatagagccgatctggccaagtacatctgtgagaaccaggacagcatctctagcaagctgaaggagtgctgtgagaagcccctgctggagaagtcccactgcatcgccgaggtggagaatgacgagatgccagcagatctgccttctctggcagcagacttcgtggagagcaaggacgtgtgcaagaactatgccgaggccaaggacgtgttcctgggcatgttcctgtatgagtacgccaggcgccacccagactattccgtggtgctgctgctgcggctggccaagacctacgagacaaccctggagaagtgctgtgcagcagccgatccccacgagtgctacgcaaaggtgtttgacgagttcaagcctctggtggaggagccacagaacctgatcaagcagaattgtgagctgttcgagcagctgggcgagtataagtttcagaatgccctgctggtgagatacaccaagaaggtgccccaggtgtccacccctacactggtggaggtgtctaggaacctgggcaaggtcggcagcaagtgctgtaagcacccagaggcaaagaggatgccatgcgcagaggactatctgtccgtggtgctgaatcagctgtgcgtgctgcacgagaagaccccagtgtctgatagggtgaccaagtgctgtacagagtccctggtgaatagacggccctgcttctctgccctggaggtggacgagacatacgtgcctaaggagtttaacgccgagacattcaccttccacgccgatatctgtaccctgagcgagaaggagcgccagatcaagaagcagacagccctggtggagctggtgaagcacaagcccaaggccaccaaggagcagctgaaggccgtgatggacgattttgccgccttcgtggagaagtgctgtaaggccgacgataaggagacatgcttcgcagaggagggcaagaagctggtggcagcatcccaggccgccctgggcctgccacctacacggagaaggcgccggagacacatccagggacctggaccaaagaagcctagacaccagcagctgctgccatccctgtcctctttctttttctctcacaggctgcctgacatgaccgccatcatcaaggagatcgtgagccgcaataagaggcgctatcaggaggatggcttcgacctggatctgacatatatctacccaaacatcatcgccatgggatttccagcagagaggctggagggcgtgtacaggaacaatatcgacgatgtggtgaggttcctggactccaagcacaagaaccactataagatctacaatctgtgcgccgagcggcactatgataccgccaagttcaactgtagagtggcccagtacccatttgaggaccacaatccaccccagctggagctgatcaagcccttttgcgaggacctggatcagtggctgagcgaggacgataatcacgtggcagcaatccactgcaaggcaggcaagggaaggacaggcgtgatgatctgtgcctatctgctgcacaggggcaagttcctgaaggcccaggaggccctggacttttacggcgaggtgcggaccagagataagaagggcgtgacaatccctagccagcggcggtacgtgtactattactcctacctgctgaagaaccacctggactaccgcccagtggccctgctgtttcacaagatgatgttcgagacaatccctatgttctccggcggcacatgcaacccacagtttgtggtgtgccagctgaaggtgaagatctatagctccaattctggccccaccaggcgcgaggataagttcatgtactttgagttcccccagcctctgccagtgtgcggcgacatcaaggtggagtttttccacaagcagaacaagatgctgaagaaggataagatgtttcacttctgggtgaatacctttttcatccccggccctgaggagacaagcgagaaggtggagaatggctccctgtgcgaccaggagatcgattctatctgtagcatcgagagggccgacaacgataaggagtacctggtgctgaccctgacaaagaatgacctggataaggccaacaaggacaaggccaatcgctatttttctcccaacttcaaggtgaagctgtacttcaccaagacagtggaggagcctagcaatccagaggcctctagctccaccagcgtgacacccgacgtgtccgataacgagcctgaccactatcggtactccgataccacagactctgatcctgagaacgagccatttgacgaagaccagcatactcagattactaaagtccaccatcatcaccaccactaataagcttggatcc

SEQ ID NO: 62 - DNA, 3243 bp, Artificial Sequence
  Description of Artificial Sequence: Synthetic polynucleotide
gaattcccgccgccaccatgaagtgggtcacctttattagtctgctgtttctgttttcttccgcttactcacgaggggtctttaggagagatgctcacaaatcagaggtggcccaccggtttaaggacctgggcgaggagaacttcaaggccctggtgctgatcgcctttgcccagtatctgcagcagtgccccttcgaggatcacgtgaagctggtgaatgaggtgaccgagtttgccaagacatgcgtggccgacgagtctgccgagaactgtgataagagcctgcacaccctgttcggcgacaagctgtgcaccgtggccacactgcgggagacatacggcgagatggccgattgctgtgccaagcaggagcccgagagaaatgagtgctttctgcagcacaaggacgataacccaaatctgccaaggctggtgcgccctgaggtggacgtgatgtgcaccgcctttcacgataacgaggagacattcctgaagaagtatctgtacgagatcgcccggagacacccatatttctacgcccccgagctgctgttctttgccaagagatataaggccgcctttaccgagtgctgtcaggcagcagacaaggcagcatgcctgctgcctaagctggacgagctgagggatgagggcaaggccagctccgccaagcagcgcctgaagtgtgccagcctgcagaagtttggcgagagggccttcaaggcctgggcagtggcaaggctgtctcagagatttccaaaggccgagttcgccgaggtgagcaagctggtgaccgatctgacaaaggtgcacaccgagtgctgtcacggcgacctgctggagtgcgcagacgatagagccgatctggccaagtacatctgtgagaaccaggacagcatctctagcaagctgaaggagtgctgtgagaagcccctgctggagaagtcccactgcatcgccgaggtggagaatgacgagatgccagcagatctgccttctctggcagcagacttcgtggagagcaaggacgtgtgcaagaactatgccgaggccaaggacgtgttcctgggcatgttcctgtatgagtacgccaggcgccacccagactattccgtggtgctgctgctgcggctggccaagacctacgagacaaccctggagaagtgctgtgcagcagccgatccccacgagtgctacgcaaaggtgtttgacgagttcaagcctctggtggaggagccacagaacctgatcaagcagaattgtgagctgttcgagcagctgggcgagtataagtttcagaatgccctgctggtgagatacaccaagaaggtgccccaggtgtccacccctacactggtggaggtgtctaggaacctgggcaaggtcggcagcaagtgctgtaagcacccagaggcaaagaggatgccatgcgcagaggactatctgtccgtggtgctgaatcagctgtgcgtgctgcacgagaagaccccagtgtctgatagggtgaccaagtgctgtacagagtccctggtgaatagacggccctgcttctctgccctggaggtggacgagacatacgtgcctaaggagtttaacgccgagacattcaccttccacgccgatatctgtaccctgagcgagaaggagcgccagatcaagaagcagacagccctggtggagctggtgaagcacaagcccaaggccaccaaggagcagctgaaggccgtgatggacgattttgccgccttcgtggagaagtgctgtaaggccgacgataaggagacatgcttcgcagaggagggcaagaagctggtggcagcatcccaggccgccctgggcctgaccaacaggcgcaagaagcgggccctggacgcagcatacccacctacacggagaaggcgccggagacacatccagggacctggaccaaagaagcctagacaccagcagctgctgccatccctgtcctctttctttttctctcacaggctgcctgacatgaccgccatcatcaaggagatcgtgagccgcaataagaggcgctatcaggaggatggcttcgacctggatctgacatatatctacccaaacatcatcgccatgggatttccagcagagaggctggagggcgtgtacaggaacaatatcgacgatgtggtgaggttcctggactccaagcacaagaaccactataagatctacaatctgtgcgccgagcggcactatgataccgccaagttcaactgtagagtggcccagtacccatttgaggaccacaatccaccccagctggagctgatcaagcccttttgcgaggacctggatcagtggctgagcgaggacgataatcacgtggcagcaatccactgcaaggcaggcaagggaaggacaggcgtgatgatctgtgcctatctgctgcacaggggcaagttcctgaaggcccaggaggccctggacttttacggcgaggtgcggaccagagataagaagggcgtgacaatccctagccagcggcggtacgtgtactattactcctacctgctgaagaaccacctggactaccgcccagtggccctgctgtttcacaagatgatgttcgagacaatccctatgttctccggcggcacatgcaacccacagtttgtggtgtgccagctgaaggtgaagatctatagctccaattctggccccaccaggcgcgaggataagttcatgtactttgagttcccccagcctctgccagtgtgcggcgacatcaaggtggagtttttccacaagcagaacaagatgctgaagaaggataagatgtttcacttctgggtgaatacctttttcatccccggccctgaggagacaagcgagaaggtggagaatggctccctgtgcgaccaggagatcgattctatctgtagcatcgagagggccgacaacgataaggagtacctggtgctgaccctgacaaagaatgacctggataaggccaacaaggacaaggccaatcgctatttttctcccaacttcaaggtgaagctgtacttcaccaagacagtggaggagcctagcaatccagaggcctctagctccaccagcgtgacacccgacgtgtccgataacgagcctgaccactatcggtactccgataccacagactctgatcctgagaacgagccatttgacgaagaccagcatactcagattactaaagtccaccatcatcaccaccactaataagcttggatcc

SEQ ID NO: 63 - DNA, 3198 bp, Artificial Sequence
  Description of Artificial Sequence: Synthetic polynucleotide
gaattcccgccgccaccatgaaatgggtcacctttatcagcctgctgttcctgttcagcagcgcctacagcagaggcgtgttcagaagagatgcccacaagagcgaggtggcccacagattcaaggacctgggcgaagagaacttcaaggccctggtgctgatcgccttcgctcagtacctgcagcagtgcccctttgaggaccacgtgaagctggtcaacgaagtgaccgagttcgccaagacctgcgtggccgatgagagcgccgagaactgtgataagagcctgcacaccctgttcggcgacaagctgtgtacagtggccacactgagagaaacctacggcgagatggccgactgctgcgccaagcaagagcccgagagaaacgagtgcttcctgcagcacaaggacgacaaccccaacctgcctagactcgtgcggcctgaagtggacgtgatgtgcaccgccttccacgacaacgaggaaaccttcctgaagaagtacctgtacgagatcgccagacggcacccctacttttacgcccctgagctgctgttcttcgccaagcggtataaggccgccttcaccgagtgttgtcaggccgctgataaggctgcctgcctgctgcctaagctggacgagcttagagatgagggcaaagccagctccgccaagcagagactgaagtgtgccagcctgcagaagttcggcgagagagcctttaaggcctgggccgttgctagactgagccagagatttcccaaggccgagtttgccgaggtgtccaagctcgtgaccgacctgacaaaggtgcacaccgaatgctgccacggcgacctgctggaatgcgccgatgatagagccgacctggccaagtacatctgcgagaaccaggacagcatcagcagcaagctgaaagagtgctgcgagaagccactgctggaaaagagccactgtatcgccgaggtggaaaacgacgagatgcccgccgatctgccttctctggccgccgattttgtggaaagcaaggacgtgtgcaagaactacgccgaggccaaggatgtgttcctgggcatgtttctgtatgagtacgcccgcagacaccccgactactctgttgtgctgctgctgagactggccaaaacctacgagacaaccctggaaaagtgctgtgccgccgctgatcctcacgagtgttacgccaaggtgttcgacgagttcaagcctctggtggaagaaccccagaacctgatcaagcagaactgcgagctgttcgagcagctgggcgagtacaagttccagaacgccctgctcgtgcggtacaccaagaaggtgccccaggtttccacacctacactggttgaggtgtcccggaacctgggcaaagtgggcagcaagtgttgcaagcaccctgaggccaagagaatgccctgcgccgaggattacctgagcgtggtgctgaatcagctgtgcgtgctgcacgagaaaacccctgtgtccgacagagtgaccaagtgctgtaccgagagcctggtcaacagacggccttgctttagcgccctcgaggtggacgagacatacgtgcccaaagagttcaacgccgagacattcaccttccacgccgacatctgtaccctgagcgagaaagagcggcagatcaagaaacagactgccctggtggaactggtcaagcacaagcccaaggccaccaaagaacagctgaaggccgtgatggacgacttcgccgccttcgtggaaaaatgctgcaaggccgacgacaaagagacatgcttcgccgaagagggcaagaaactggtggccgcttctcaggctgctctcggactgctgcctcctaccagacggcggagaaggcggcatatacaaggaccaggacctgtgctgaacctgccatctgctgctgcagctcctcctgtggctagagcacctgaagctgctatgaccgccatcatcaaagaaatcgtgtctcggaacaagcggcgctaccaagaggacggcttcgacctggatctgacctacatctaccccaacatcattgccatgggcttccccgccgaaagactggaaggggtgtaccggaacaacatcgacgatgtcgtgcggttcctggactctaagcacaagaaccactacaagatctacaacctgtgcgccgagcggcactacgacaccgccaagttcaattgcagagtggcccagtatcctttcgaggatcacaaccctccacagctcgaactgattaagcccttctgcgaggacctggaccagtggctgagcgaggacgataatcacgtggccgccatccactgcaaagccggcaagggaagaaccggcgtgatgatctgtgcttacctgctgcaccggggcaagtttctgaaggcccaagaggctctggacttctacggcgaagtgcggaccagagacaagaaaggcgtgacaatccccagccagcggagatacgtgtactactacagctacctgctgaagaaccacctggactacagacccgtcgctctgctgtttcacaagatgatgttcgagactatccccatgttctccggcggcacctgtaatccccagttcgtcgtgtgtcagctcaaagtgaagatctactccagcaacagcggccccaccagacgcgaggataagttcatgtacttcgagttcccacagccactgcctgtgtgcggcgatatcaaggtggaatttttccataagcagaacaagatgctgaaaaaggacaagatgttccacttctgggtcaacaccttcttcatccccggacctgaagagacaagcgagaaggtcgagaacggctccctgtgcgaccaagagatcgacagcatctgctccatcgagcgggccgacaatgacaaagaatacctggtgctcaccctgaccaagaacgatctggacaaggccaacaaggataaggccaaccggtacttcagccccaacttcaaagtcaagctgtacttcaccaagaccgtcgaggaacccagcaatccagaggccagctctagcacctctgtgacccctgacgtgtccgataacgagcccgaccactacagatacagcgacaccaccgacagcgaccccgagaacgagccttttgatgaggaccagcacacccagatcaccaaggtgcaccaccaccatcaccactgataagcttggatcc

SEQ ID NO: 64 - DNA, 3210 bp, Artificial Sequence
  Description of Artificial Sequence: Synthetic polynucleotide
gaattcccgccgccaccatgaaatgggtcacctttatcagcctgctgttcctgttcagcagcgcctacagcagaggcgtgttcagaagagatgcccacaagagcgaggtggcccacagattcaaggacctgggcgaagagaacttcaaggccctggtgctgatcgccttcgctcagtacctgcagcagtgcccctttgaggaccacgtgaagctggtcaacgaagtgaccgagttcgccaagacctgcgtggccgatgagagcgccgagaactgtgataagagcctgcacaccctgttcggcgacaagctgtgtacagtggccacactgagagaaacctacggcgagatggccgactgctgcgccaagcaagagcccgagagaaacgagtgcttcctgcagcacaaggacgacaaccccaacctgcctagactcgtgcggcctgaagtggacgtgatgtgcaccgccttccacgacaacgaggaaaccttcctgaagaagtacctgtacgagatcgccagacggcacccctacttttacgcccctgagctgctgttcttcgccaagcggtataaggccgccttcaccgagtgttgtcaggccgctgataaggctgcctgcctgctgcctaagctggacgagcttagagatgagggcaaagccagctccgccaagcagagactgaagtgtgccagcctgcagaagttcggcgagagagcctttaaggcctgggccgttgctagactgagccagagatttcccaaggccgagtttgccgaggtgtccaagctcgtgaccgacctgacaaaggtgcacaccgaatgctgccacggcgacctgctggaatgcgccgatgatagagccgacctggccaagtacatctgcgagaaccaggacagcatcagcagcaagctgaaagagtgctgcgagaagccactgctggaaaagagccactgtatcgccgaggtggaaaacgacgagatgcccgccgatctgccttctctggccgccgattttgtggaaagcaaggacgtgtgcaagaactacgccgaggccaaggatgtgttcctgggcatgtttctgtatgagtacgcccgcagacaccccgactactctgttgtgctgctgctgagactggccaaaacctacgagacaaccctggaaaagtgctgtgccgccgctgatcctcacgagtgttacgccaaggtgttcgacgagttcaagcctctggtggaagaaccccagaacctgatcaagcagaactgcgagctgttcgagcagctgggcgagtacaagttccagaacgccctgctcgtgcggtacaccaagaaggtgccccaggtttccacacctacactggttgaggtgtcccggaacctgggcaaagtgggcagcaagtgttgcaagcaccctgaggccaagagaatgccctgcgccgaggattacctgagcgtggtgctgaatcagctgtgcgtgctgcacgagaaaacccctgtgtccgacagagtgaccaagtgctgtaccgagagcctggtcaacagacggccttgctttagcgccctcgaggtggacgagacatacgtgcccaaagagttcaacgccgagacattcaccttccacgccgacatctgtaccctgagcgagaaagagcggcagatcaagaaacagactgccctggtggaactggtcaagcacaagcccaaggccaccaaagaacagctgaaggccgtgatggacgacttcgccgccttcgtggaaaaatgctgcaaggccgacgacaaagagacatgcttcgccgaagagggcaagaaactggtggccgcttctcaggctgctctcggacttggcggaggctctagaagcgaggactactctagcagccctcattctgctgccgctgccgctagacctctggctgccgaagaaaaacaggcccagagtctgcagcctagcagctccagaagaagcatgaccgccatcatcaaagaaatcgtgtctcggaacaagcggcgctaccaagaggacggcttcgacctggatctgacctacatctaccccaacatcattgccatgggcttccccgccgaaagactggaaggggtgtaccggaacaacatcgacgatgtcgtgcggttcctggactctaagcacaagaaccactacaagatctacaacctgtgcgccgagcggcactacgacaccgccaagttcaattgcagagtggcccagtatcctttcgaggatcacaaccctccacagctcgaactgattaagcccttctgcgaggacctggaccagtggctgagcgaggacgataatcacgtggccgccatccactgcaaagccggcaagggaagaaccggcgtgatgatctgtgcttacctgctgcaccggggcaagtttctgaaggcccaagaggctctggacttctacggcgaagtgcggaccagagacaagaaaggcgtgacaatccccagccagcggagatacgtgtactactacagctacctgctgaagaaccacctggactacagacccgtcgctctgctgtttcacaagatgatgttcgagactatccccatgttctccggcggcacctgtaatccccagttcgtcgtgtgtcagctcaaagtgaagatctactccagcaacagcggccccaccagacgcgaggataagttcatgtacttcgagttcccacagccactgcctgtgtgcggcgatatcaaggtggaatttttccataagcagaacaagatgctgaaaaaggacaagatgttccacttctgggtcaacaccttcttcatccccggacctgaagagacaagcgagaaggtcgagaacggctccctgtgcgaccaagagatcgacagcatctgctccatcgagcgggccgacaatgacaaagaatacctggtgctcaccctgaccaagaacgatctggacaaggccaacaaggataaggccaaccggtacttcagccccaacttcaaagtcaagctgtacttcaccaagaccgtcgaggaacccagcaatccagaggccagctctagcacctctgtgacccctgacgtgtccgataacgagcccgaccactacagatacagcgacaccaccgacagcgaccccgagaacgagccttttgatgaggaccagcacacccagatcaccaaggtgcaccaccaccatcaccactgataagcttggatcc

SEQ ID NO: 65 - DNA, 3246 bp, Artificial Sequence
  Description of Artificial Sequence: Synthetic polynucleotide
gaattcccgccgccaccatgaaatgggtcacctttatcagcctgctgttcctgttcagcagcgcctacagcagaggcgtgttcagaagagatgcccacaagagcgaggtggcccacagattcaaggacctgggcgaagagaacttcaaggccctggtgctgatcgccttcgctcagtacctgcagcagtgcccctttgaggaccacgtgaagctggtcaacgaagtgaccgagttcgccaagacctgcgtggccgatgagagcgccgagaactgtgataagagcctgcacaccctgttcggcgacaagctgtgtacagtggccacactgagagaaacctacggcgagatggccgactgctgcgccaagcaagagcccgagagaaacgagtgcttcctgcagcacaaggacgacaaccccaacctgcctagactcgtgcggcctgaagtggacgtgatgtgcaccgccttccacgacaacgaggaaaccttcctgaagaagtacctgtacgagatcgccagacggcacccctacttttacgcccctgagctgctgttcttcgccaagcggtataaggccgccttcaccgagtgttgtcaggccgctgataaggctgcctgcctgctgcctaagctggacgagcttagagatgagggcaaagccagctccgccaagcagagactgaagtgtgccagcctgcagaagttcggcgagagagcctttaaggcctgggccgttgctagactgagccagagatttcccaaggccgagtttgccgaggtgtccaagctcgtgaccgacctgacaaaggtgcacaccgaatgctgccacggcgacctgctggaatgcgccgatgatagagccgacctggccaagtacatctgcgagaaccaggacagcatcagcagcaagctgaaagagtgctgcgagaagccactgctggaaaagagccactgtatcgccgaggtggaaaacgacgagatgcccgccgatctgccttctctggccgccgattttgtggaaagcaaggacgtgtgcaagaactacgccgaggccaaggatgtgttcctgggcatgtttctgtatgagtacgcccgcagacaccccgactactctgttgtgctgctgctgagactggccaaaacctacgagacaaccctggaaaagtgctgtgccgccgctgatcctcacgagtgttacgccaaggtgttcgacgagttcaagcctctggtggaagaaccccagaacctgatcaagcagaactgcgagctgttcgagcagctgggcgagtacaagttccagaacgccctgctcgtgcggtacaccaagaaggtgccccaggtttccacacctacactggttgaggtgtcccggaacctgggcaaagtgggcagcaagtgttgcaagcaccctgaggccaagagaatgccctgcgccgaggattacctgagcgtggtgctgaatcagctgtgcgtgctgcacgagaaaacccctgtgtccgacagagtgaccaagtgctgtaccgagagcctggtcaacagacggccttgctttagcgccctcgaggtggacgagacatacgtgcccaaagagttcaacgccgagacattcaccttccacgccgacatctgtaccctgagcgagaaagagcggcagatcaagaaacagactgccctggtggaactggtcaagcacaagcccaaggccaccaaagaacagctgaaggccgtgatggacgacttcgccgccttcgtggaaaaatgctgcaaggccgacgacaaagagacatgcttcgccgaagagggcaagaaactggtggccgcttctcaggctgctctcggacttagccattatcctgccgccgtgcagtcacaggctgcagctgaaaggggagcctctgccacagccaagagcagagccatcagcatcctgcagaaaaagccccggcaccagcaactgctgccaagcctgagcagcttcttcttctctcaccggctgcctgacatgaccgccatcatcaaagaaatcgtgtctcggaacaagcggcgctaccaagaggacggcttcgacctggatctgacctacatctaccccaacatcattgccatgggcttccccgccgaaagactggaaggggtgtaccggaacaacatcgacgatgtcgtgcggttcctggactctaagcacaagaaccactacaagatctacaacctgtgcgccgagcggcactacgacaccgccaagttcaattgcagagtggcccagtatcctttcgaggatcacaaccctccacagctcgaactgattaagcccttctgcgaggacctggaccagtggctgagcgaggacgataatcacgtggccgccatccactgcaaagccggcaagggaagaaccggcgtgatgatctgtgcttacctgctgcaccggggcaagtttctgaaggcccaagaggctctggacttctacggcgaagtgcggaccagagacaagaaaggcgtgacaatccccagccagcggagatacgtgtactactacagctacctgctgaagaaccacctggactacagacccgtcgctctgctgtttcacaagatgatgttcgagactatccccatgttctccggcggcacctgtaatccccagttcgtcgtgtgtcagctcaaagtgaagatctactccagcaacagcggccccaccagacgcgaggataagttcatgtacttcgagttcccacagccactgcctgtgtgcggcgatatcaaggtggaatttttccataagcagaacaagatgctgaaaaaggacaagatgttccacttctgggtcaacaccttcttcatccccggacctgaagagacaagcgagaaggtcgagaacggctccctgtgcgaccaagagatcgacagcatctgctccatcgagcgggccgacaatgacaaagaatacctggtgctcaccctgaccaagaacgatctggacaaggccaacaaggataaggccaaccggtacttcagccccaacttcaaagtcaagctgtacttcaccaagaccgtcgaggaacccagcaatccagaggccagctctagcacctctgtgacccctgacgtgtccgataacgagcccgaccactacagatacagcgacaccaccgacagcgaccccgagaacgagccttttgatgaggaccagcacacccagatcaccaaggtgcaccaccaccatcaccactgataagcttggatcc

SEQ ID NO: 66 - DNA, 3624 bp, Artificial Sequence
  Description of Artificial Sequence: Synthetic polynucleotide
gaattcccgccgccaccatgaagtgggtgacctttattagcctgctgttcctgtttagttccgcatactcaagaggggtgtttagaagaagcgagagccctgtgaccatctccagggccggaaatgcaggagagctggtgtctcctctgctgctgccacctacacggagaaggcgccggagacacatccagggaccaggacctgtgctgaacctgccaagcgccgccgccgccccacccgtggccagagccccagaggcagcaggaggaggctccagatctgaggactatagctcctctccacacagcgccgccgccgccgcccggcccctggccgccgaggagaagcaggcccagtctctgcagcccagctcctctaggcgcagctcccactaccctgcagcagtgcagtcccaggctgccgccgagaggggagcctctgccaccgcaaagtctcgcgccatcagcatcctgcagaagaagccacgccaccagcagctgctgccctctctgtctagcttctttttcagccaccggctgcccgacatgaccgccatcatcaaggagatcgtgagcagaaataagcggcggtaccaggaggatggcttcgacctggatctgacatatatctaccccaacatcatcgccatgggatttcctgcagagcggctggagggcgtgtacagaaacaatatcgacgatgtggtgaggttcctggactccaagcacaagaaccactataagatctacaatctgtgcgccgagaggcactatgataccgccaagttcaactgtcgcgtggcccagtacccctttgaggaccacaatcctccacagctggagctgatcaagcctttctgcgaggacctggatcagtggctgtccgaggacgataatcacgtggcagcaatccactgcaaggcaggcaagggcaggacaggcgtgatgatctgtgcctatctgctgcaccgcggcaagttcctgaaggcccaggaggccctggacttttacggcgaggtgaggacccgcgataagaagggcgtgacaatcccaagccagcggcggtacgtgtactattactcctacctgctgaagaaccacctggactacaggccagtggccctgctgtttcacaagatgatgttcgagacaatccctatgttctccggcggcacatgcaacccacagtttgtggtgtgccagctgaaggtgaagatctattcctctaattctggcccaacccggagagaggataagttcatgtactttgagttcccacagccactgcccgtgtgcggcgacatcaaggtggagtttttccacaagcagaacaagatgctgaagaaggataagatgtttcacttctgggtgaatacctttttcatcccaggccccgaggagacatccgagaaggtggagaatggctctctgtgcgaccaggagatcgatagcatctgttccatcgagcgggccgacaacgataaggagtacctggtgctgaccctgacaaagaatgacctggataaggccaacaaggacaaggccaatagatacttcagccccaacttcaaggtgaagctgtacttcaccaagacagtggaggagccttccaatccagaggccagctcctctaccagcgtgacacctgacgtgtccgataacgagccagaccactatcggtactccgataccacagactctgatccagagaacgagccctttgacgaggatcagcacacccagatcacaaaggtgcatcaccaccaccaccacggacctgccgccctgaaggcagcaaccaataggcgcaagaagagggccctggacgcagcatatgatgcccacaagagcgaggtggcccaccgctttaaggacctgggcgaggagaacttcaaggccctggtgctgatcgcctttgcccagtacctgcagcagtgcccattcgaggatcacgtgaagctggtgaatgaggtgaccgagtttgccaagacatgcgtggccgacgagagcgccgagaactgtgataagtccctgcacaccctgttcggcgacaagctgtgcaccgtggccacactgcgggagacatatggcgagatggccgattgctgtgccaaacaggagcctgagagaaatgagtgctttctgcagcacaaggacgataacccaaatctgcctaggctggtgcggcccgaggtggacgtgatgtgcaccgcctttcacgataacgaggagacattcctgaagaagtatctgtacgagatcgcccggagacacccctatttctacgcccctgagctgctgtttttcgccaagagatacaaggccgcctttaccgagtgctgtcaggcagcagacaaggcagcatgcctgctgccaaagctggacgagctgagggatgagggcaaggccagctccgccaagcagagactgaagtgtgccagcctgcagaagtttggagagagggccttcaaggcctgggcagtggcaaggctgagccagcggttcccaaaggcagagttcgcagaggtgtccaagctggtgaccgatctgacaaaggtgcacaccgagtgctgtcacggcgacctgctggagtgcgcagacgatagggcagatctggccaagtacatctgtgagaaccaggactctatctctagcaagctgaaggagtgctgtgagaagcccctgctggagaagagccactgcatcgccgaggtggagaatgacgagatgcctgccgatctgccatctctggccgccgacttcgtggagagcaaggacgtgtgcaagaactatgccgaggccaaggacgtgtttctgggcatgttcctgtatgagtacgccaggcgccaccccgattattccgtggtgctgctgctgcggctggccaagacctacgagacaaccctggagaagtgctgtgccgccgccgacccccacgagtgctacgcaaaggtgtttgacgagttcaagccactggtggaggagccccagaacctgatcaagcagaattgtgagctgttcgagcagctgggcgagtataagtttcagaatgccctgctggtgagatacacaaagaaggtgcctcaggtgtccaccccaacactggtggaggtgtctaggaacctgggcaaggtcggcagcaagtgctgtaagcacccagaggcaaagaggatgccttgcgccgaggactatctgtctgtggtgctgaaccagctgtgcgtgctgcacgagaagacccccgtgagcgatcgggtgaccaagtgctgtacagagtctctggtgaatagacggccctgcttcagcgccctggaggtggacgagacatacgtgccaaaggagtttaacgccgagacattcaccttccacgccgacatctgtaccctgtccgagaaggagagacagatcaagaagcagacagccctggtggagctggtgaagcacaagcctaaggccaccaaggagcagctgaaggccgtgatggacgattttgccgccttcgtggagaagtgctgtaaggccgacgataaggagacatgcttcgccgaggagggcaagaagctggtcgccgcttcacaggctgctctggggctggactacaaggacgatgatgacaaatgataagctt

SEQ ID NO: 67 - DNA, 3582 bp, Artificial Sequence
  Description of Artificial Sequence: Synthetic polynucleotide
gaattcccgccgccaccatgaagtgggtgacctttattagcctgctgttcctgtttagttccgcatactcaagaggggtgtttagaagaagcgagagccctgtgaccatctccagggccggaaatgcaggagagctggtgtctcctctgctgctgccacctacacggagaaggcgccggagacacatccagggaccaggacctgtgctgaacctgccaagcgccgccgccgccccacccgtggccagagccccagaggcagcaggaggaggctccagatctgaggactatagctcctctccacacagcgccgccgccgccgcccggcccctggccgccgaggagaagcaggcccagtctctgcagcccagctcctctaggcgcagctcccactaccctgcagcagtgcagtcccaggctgccgccgagaggggagcctctgccaccgcaaagtctcgcgccatcagcatcctgcagaagaagccacgccaccagcagctgctgccctctctgtctagcttctttttcagccaccggctgcccgacatgaccgccatcatcaaggagatcgtgagcagaaataagcggcggtaccaggaggatggcttcgacctggatctgacatatatctaccccaacatcatcgccatgggatttcctgcagagcggctggagggcgtgtacagaaacaatatcgacgatgtggtgaggttcctggactccaagcacaagaaccactataagatctacaatctgtgcgccgagaggcactatgataccgccaagttcaactgtcgcgtggcccagtacccctttgaggaccacaatcctccacagctggagctgatcaagcctttctgcgaggacctggatcagtggctgtccgaggacgataatcacgtggcagcaatccactgcaaggcaggcaagggcaggacaggcgtgatgatctgtgcctatctgctgcaccgcggcaagttcctgaaggcccaggaggccctggacttttacggcgaggtgaggacccgcgataagaagggcgtgacaatcccaagccagcggcggtacgtgtactattactcctacctgctgaagaaccacctggactacaggccagtggccctgctgtttcacaagatgatgttcgagacaatccctatgttctccggcggcacatgcaacccacagtttgtggtgtgccagctgaaggtgaagatctattcctctaattctggcccaacccggagagaggataagttcatgtactttgagttcccacagccactgcccgtgtgcggcgacatcaaggtggagtttttccacaagcagaacaagatgctgaagaaggataagatgtttcacttctgggtgaatacctttttcatcccaggccccgaggagacatccgagaaggtggagaatggctctctgtgcgaccaggagatcgatagcatctgttccatcgagcgggccgacaacgataaggagtacctggtgctgaccctgacaaagaatgacctggataaggccaacaaggacaaggccaatagatacttcagccccaacttcaaggtgaagctgtacttcaccaagacagtggaggagccttccaatccagaggccagctcctctaccagcgtgacacctgacgtgtccgataacgagccagaccactatcggtactccgataccacagactctgatccagagaacgagccctttgacgaggatcagcacacccagatcacaaaggtgaccaataggcgcaagaagagggccctggacgcagcatatgatgcccacaagagcgaggtggcccaccgctttaaggacctgggcgaggagaacttcaaggccctggtgctgatcgcctttgcccagtacctgcagcagtgcccattcgaggatcacgtgaagctggtgaatgaggtgaccgagtttgccaagacatgcgtggccgacgagagcgccgagaactgtgataagtccctgcacaccctgttcggcgacaagctgtgcaccgtggccacactgcgggagacatatggcgagatggccgattgctgtgccaaacaggagcctgagagaaatgagtgctttctgcagcacaaggacgataacccaaatctgcctaggctggtgcggcccgaggtggacgtgatgtgcaccgcctttcacgataacgaggagacattcctgaagaagtatctgtacgagatcgcccggagacacccctatttctacgcccctgagctgctgtttttcgccaagagatacaaggccgcctttaccgagtgctgtcaggcagcagacaaggcagcatgcctgctgccaaagctggacgagctgagggatgagggcaaggccagctccgccaagcagagactgaagtgtgccagcctgcagaagtttggagagagggccttcaaggcctgggcagtggcaaggctgagccagcggttcccaaaggcagagttcgcagaggtgtccaagctggtgaccgatctgacaaaggtgcacaccgagtgctgtcacggcgacctgctggagtgcgcagacgatagggcagatctggccaagtacatctgtgagaaccaggactctatctctagcaagctgaaggagtgctgtgagaagcccctgctggagaagagccactgcatcgccgaggtggagaatgacgagatgcctgccgatctgccatctctggccgccgacttcgtggagagcaaggacgtgtgcaagaactatgccgaggccaaggacgtgtttctgggcatgttcctgtatgagtacgccaggcgccaccccgattattccgtggtgctgctgctgcggctggccaagacctacgagacaaccctggagaagtgctgtgccgccgccgacccccacgagtgctacgcaaaggtgtttgacgagttcaagccactggtggaggagccccagaacctgatcaagcagaattgtgagctgttcgagcagctgggcgagtataagtttcagaatgccctgctggtgagatacacaaagaaggtgcctcaggtgtccaccccaacactggtggaggtgtctaggaacctgggcaaggtcggcagcaagtgctgtaagcacccagaggcaaagaggatgccttgcgccgaggactatctgtctgtggtgctgaaccagctgtgcgtgctgcacgagaagacccccgtgagcgatcgggtgaccaagtgctgtacagagtctctggtgaatagacggccctgcttcagcgccctggaggtggacgagacatacgtgccaaaggagtttaacgccgagacattcaccttccacgccgacatctgtaccctgtccgagaaggagagacagatcaagaagcagacagccctggtggagctggtgaagcacaagcctaaggccaccaaggagcagctgaaggccgtgatggacgattttgccgccttcgtggagaagtgctgtaaggccgacgataaggagacatgcttcgccgaggagggcaagaagctggtcgccgcttcacaggctgctctggggctgcatcaccaccaccaccactgataagcttggatcc

SEQ ID NO: 68 - DNA, 3543 bp, Artificial Sequence
  Description of Artificial Sequence: Synthetic polynucleotide
gaattcccgccgccaccatgaagtgggtgacctttattagcctgctgttcctgtttagttccgcatactcaagaggggtgtttagaagaagcgagagccctgtgaccatctccagggccggaaatgcaggagagctggtgtctcctctgctgctgccacctacacggagaaggcgccggagacacatccagggaccaggacctgtgctgaacctgccaagcgccgccgccgccccacccgtggccagagccccagaggcagcaggaggaggctccagatctgaggactatagctcctctccacacagcgccgccgccgccgcccggcccctggccgccgaggagaagcaggcccagtctctgcagcccagctcctctaggcgcagctcccactaccctgcagcagtgcagtcccaggctgccgccgagaggggagcctctgccaccgcaaagtctcgcgccatcagcatcctgcagaagaagccacgccaccagcagctgctgccctctctgtctagcttctttttcagccaccggctgcccgacatgaccgccatcatcaaggagatcgtgagcagaaataagcggcggtaccaggaggatggcttcgacctggatctgacatatatctaccccaacatcatcgccatgggatttcctgcagagcggctggagggcgtgtacagaaacaatatcgacgatgtggtgaggttcctggactccaagcacaagaaccactataagatctacaatctgtgcgccgagaggcactatgataccgccaagttcaactgtcgcgtggcccagtacccctttgaggaccacaatcctccacagctggagctgatcaagcctttctgcgaggacctggatcagtggctgtccgaggacgataatcacgtggcagcaatccactgcaaggcaggcaagggcaggacaggcgtgatgatctgtgcctatctgctgcaccgcggcaagttcctgaaggcccaggaggccctggacttttacggcgaggtgaggacccgcgataagaagggcgtgacaatcccaagccagcggcggtacgtgtactattactcctacctgctgaagaaccacctggactacaggccagtggccctgctgtttcacaagatgatgttcgagacaatccctatgttctccggcggcacatgcaacccacagtttgtggtgtgccagctgaaggtgaagatctattcctctaattctggcccaacccggagagaggataagttcatgtactttgagttcccacagccactgcccgtgtgcggcgacatcaaggtggagtttttccacaagcagaacaagatgctgaagaaggataagatgtttcacttctgggtgaatacctttttcatcccaggccccgaggagacatccgagaaggtggagaatggctctctgtgcgaccaggagatcgatagcatctgttccatcgagcgggccgacaacgataaggagtacctggtgctgaccctgacaaagaatgacctggataaggccaacaaggacaaggccaatagatacttcagccccaacttcaaggtgaagctgtacttcaccaagacagtggaggagccttccaatccagaggccagctcctctaccagcgtgacacctgacgtgtccgataacgagccagaccactatcggtactccgataccacagactctgatccagagaacgagccctttgacgaggatcagcacacccagatcacaaaggtggatgcccacaagagcgaggtggcccaccgctttaaggacctgggcgaggagaacttcaaggccctggtgctgatcgcctttgcccagtacctgcagcagtgcccattcgaggatcacgtgaagctggtgaatgaggtgaccgagtttgccaagacatgcgtggccgacgagagcgccgagaactgtgataagtccctgcacaccctgttcggcgacaagctgtgcaccgtggccacactgcgggagacatatggcgagatggccgattgctgtgccaaacaggagcctgagagaaatgagtgctttctgcagcacaaggacgataacccaaatctgcctaggctggtgcggcccgaggtggacgtgatgtgcaccgcctttcacgataacgaggagacattcctgaagaagtatctgtacgagatcgcccggagacacccctatttctacgcccctgagctgctgtttttcgccaagagatacaaggccgcctttaccgagtgctgtcaggcagcagacaaggcagcatgcctgctgccaaagctggacgagctgagggatgagggcaaggccagctccgccaagcagagactgaagtgtgccagcctgcagaagtttggagagagggccttcaaggcctgggcagtggcaaggctgagccagcggttcccaaaggcagagttcgcagaggtgtccaagctggtgaccgatctgacaaaggtgcacaccgagtgctgtcacggcgacctgctggagtgcgcagacgatagggcagatctggccaagtacatctgtgagaaccaggactctatctctagcaagctgaaggagtgctgtgagaagcccctgctggagaagagccactgcatcgccgaggtggagaatgacgagatgcctgccgatctgccatctctggccgccgacttcgtggagagcaaggacgtgtgcaagaactatgccgaggccaaggacgtgtttctgggcatgttcctgtatgagtacgccaggcgccaccccgattattccgtggtgctgctgctgcggctggccaagacctacgagacaaccctggagaagtgctgtgccgccgccgacccccacgagtgctacgcaaaggtgtttgacgagttcaagccactggtggaggagccccagaacctgatcaagcagaattgtgagctgttcgagcagctgggcgagtataagtttcagaatgccctgctggtgagatacacaaagaaggtgcctcaggtgtccaccccaacactggtggaggtgtctaggaacctgggcaaggtcggcagcaagtgctgtaagcacccagaggcaaagaggatgccttgcgccgaggactatctgtctgtggtgctgaaccagctgtgcgtgctgcacgagaagacccccgtgagcgatcgggtgaccaagtgctgtacagagtctctggtgaatagacggccctgcttcagcgccctggaggtggacgagacatacgtgccaaaggagtttaacgccgagacattcaccttccacgccgacatctgtaccctgtccgagaaggagagacagatcaagaagcagacagccctggtggagctggtgaagcacaagcctaaggccaccaaggagcagctgaaggccgtgatggacgattttgccgccttcgtggagaagtgctgtaaggccgacgataaggagacatgcttcgccgaggagggcaagaagctggtcgccgcttcacaggctgctctggggctgcatcaccaccaccaccactgataagcttggatcc

SEQ ID NO: 69 - DNA, 3222 bp, Artificial Sequence
  Description of Artificial Sequence: Synthetic polynucleotide
gaattcccgccgccaccatgaagtgggtgacctttattagcctgctgttcctgtttagttccgcatactcaagaggggtgtttagaagaagcgagagccctgtgaccccacctacacggagaaggcgccggagacacatccagggaccaggacctaagaagccacgccaccagcagctgctgccctctctgtctagcttctttttcagccaccggctgcccgacatgaccgccatcatcaaggagatcgtgagcagaaataagcggcggtaccaggaggatggcttcgacctggatctgacatatatctaccccaacatcatcgccatgggatttcctgcagagcggctggagggcgtgtacagaaacaatatcgacgatgtggtgaggttcctggactccaagcacaagaaccactataagatctacaatctgtgcgccgagaggcactatgataccgccaagttcaactgtcgcgtggcccagtacccctttgaggaccacaatcctccacagctggagctgatcaagcctttctgcgaggacctggatcagtggctgtccgaggacgataatcacgtggcagcaatccactgcaaggcaggcaagggcaggacaggcgtgatgatctgtgcctatctgctgcaccgcggcaagttcctgaaggcccaggaggccctggacttttacggcgaggtgaggacccgcgataagaagggcgtgacaatcccaagccagcggcggtacgtgtactattactcctacctgctgaagaaccacctggactacaggccagtggccctgctgtttcacaagatgatgttcgagacaatccctatgttctccggcggcacatgcaacccacagtttgtggtgtgccagctgaaggtgaagatctattcctctaattctggcccaacccggagagaggataagttcatgtactttgagttcccacagccactgcccgtgtgcggcgacatcaaggtggagtttttccacaagcagaacaagatgctgaagaaggataagatgtttcacttctgggtgaatacctttttcatcccaggccccgaggagacatccgagaaggtggagaatggctctctgtgcgaccaggagatcgatagcatctgttccatcgagcgggccgacaacgataaggagtacctggtgctgaccctgacaaagaatgacctggataaggccaacaaggacaaggccaatagatacttcagccccaacttcaaggtgaagctgtacttcaccaagacagtggaggagccttccaatccagaggccagctcctctaccagcgtgacacctgacgtgtccgataacgagccagaccactatcggtactccgataccacagactctgatccagagaacgagccctttgacgaggatcagcacacccagatcacaaaggtggatgcccacaagagcgaggtggcccaccgctttaaggacctgggcgaggagaacttcaaggccctggtgctgatcgcctttgcccagtacctgcagcagtgcccattcgaggatcacgtgaagctggtgaatgaggtgaccgagtttgccaagacatgcgtggccgacgagagcgccgagaactgtgataagtccctgcacaccctgttcggcgacaagctgtgcaccgtggccacactgcgggagacatatggcgagatggccgattgctgtgccaaacaggagcctgagagaaatgagtgctttctgcagcacaaggacgataacccaaatctgcctaggctggtgcggcccgaggtggacgtgatgtgcaccgcctttcacgataacgaggagacattcctgaagaagtatctgtacgagatcgcccggagacacccctatttctacgcccctgagctgctgtttttcgccaagagatacaaggccgcctttaccgagtgctgtcaggcagcagacaaggcagcatgcctgctgccaaagctggacgagctgagggatgagggcaaggccagctccgccaagcagagactgaagtgtgccagcctgcagaagtttggagagagggccttcaaggcctgggcagtggcaaggctgagccagcggttcccaaaggcagagttcgcagaggtgtccaagctggtgaccgatctgacaaaggtgcacaccgagtgctgtcacggcgacctgctggagtgcgcagacgatagggcagatctggccaagtacatctgtgagaaccaggactctatctctagcaagctgaaggagtgctgtgagaagcccctgctggagaagagccactgcatcgccgaggtggagaatgacgagatgcctgccgatctgccatctctggccgccgacttcgtggagagcaaggacgtgtgcaagaactatgccgaggccaaggacgtgtttctgggcatgttcctgtatgagtacgccaggcgccaccccgattattccgtggtgctgctgctgcggctggccaagacctacgagacaaccctggagaagtgctgtgccgccgccgacccccacgagtgctacgcaaaggtgtttgacgagttcaagccactggtggaggagccccagaacctgatcaagcagaattgtgagctgttcgagcagctgggcgagtataagtttcagaatgccctgctggtgagatacacaaagaaggtgcctcaggtgtccaccccaacactggtggaggtgtctaggaacctgggcaaggtcggcagcaagtgctgtaagcacccagaggcaaagaggatgccttgcgccgaggactatctgtctgtggtgctgaaccagctgtgcgtgctgcacgagaagacccccgtgagcgatcgggtgaccaagtgctgtacagagtctctggtgaatagacggccctgcttcagcgccctggaggtggacgagacatacgtgccaaaggagtttaacgccgagacattcaccttccacgccgacatctgtaccctgtccgagaaggagagacagatcaagaagcagacagccctggtggagctggtgaagcacaagcctaaggccaccaaggagcagctgaaggccgtgatggacgattttgccgccttcgtggagaagtgctgtaaggccgacgataaggagacatgcttcgccgaggagggcaagaagctggtcgccgcttcacaggctgctctggggctgcatcaccaccaccaccactgataagcttggatcc

SEQ ID NO: 70 - DNA, 3261 bp, Artificial Sequence
  Description of Artificial Sequence: Synthetic polynucleotide
gaattcccgccgccaccatgaagtgggtgacctttattagcctgctgttcctgtttagttccgcatactcaagaggggtgtttagaagaagcgagagccctgtgaccccacctacacggagaaggcgccggagacacatccagggaccaggacctaagaagccacgccaccagcagctgctgccctctctgtctagcttctttttcagccaccggctgcccgacatgaccgccatcatcaaggagatcgtgagcagaaataagcggcggtaccaggaggatggcttcgacctggatctgacatatatctaccccaacatcatcgccatgggatttcctgcagagcggctggagggcgtgtacagaaacaatatcgacgatgtggtgaggttcctggactccaagcacaagaaccactataagatctacaatctgtgcgccgagaggcactatgataccgccaagttcaactgtcgcgtggcccagtacccctttgaggaccacaatcctccacagctggagctgatcaagcctttctgcgaggacctggatcagtggctgtccgaggacgataatcacgtggcagcaatccactgcaaggcaggcaagggcaggacaggcgtgatgatctgtgcctatctgctgcaccgcggcaagttcctgaaggcccaggaggccctggacttttacggcgaggtgaggacccgcgataagaagggcgtgacaatcccaagccagcggcggtacgtgtactattactcctacctgctgaagaaccacctggactacaggccagtggccctgctgtttcacaagatgatgttcgagacaatccctatgttctccggcggcacatgcaacccacagtttgtggtgtgccagctgaaggtgaagatctattcctctaattctggcccaacccggagagaggataagttcatgtactttgagttcccacagccactgcccgtgtgcggcgacatcaaggtggagtttttccacaagcagaacaagatgctgaagaaggataagatgtttcacttctgggtgaatacctttttcatcccaggccccgaggagacatccgagaaggtggagaatggctctctgtgcgaccaggagatcgatagcatctgttccatcgagcgggccgacaacgataaggagtacctggtgctgaccctgacaaagaatgacctggataaggccaacaaggacaaggccaatagatacttcagccccaacttcaaggtgaagctgtacttcaccaagacagtggaggagccttccaatccagaggccagctcctctaccagcgtgacacctgacgtgtccgataacgagccagaccactatcggtactccgataccacagactctgatccagagaacgagccctttgacgaggatcagcacacccagatcacaaaggtgaccaataggcgcaagaagagggccctggacgcagcatatgatgcccacaagagcgaggtggcccaccgctttaaggacctgggcgaggagaacttcaaggccctggtgctgatcgcctttgcccagtacctgcagcagtgcccattcgaggatcacgtgaagctggtgaatgaggtgaccgagtttgccaagacatgcgtggccgacgagagcgccgagaactgtgataagtccctgcacaccctgttcggcgacaagctgtgcaccgtggccacactgcgggagacatatggcgagatggccgattgctgtgccaaacaggagcctgagagaaatgagtgctttctgcagcacaaggacgataacccaaatctgcctaggctggtgcggcccgaggtggacgtgatgtgcaccgcctttcacgataacgaggagacattcctgaagaagtatctgtacgagatcgcccggagacacccctatttctacgcccctgagctgctgtttttcgccaagagatacaaggccgcctttaccgagtgctgtcaggcagcagacaaggcagcatgcctgctgccaaagctggacgagctgagggatgagggcaaggccagctccgccaagcagagactgaagtgtgccagcctgcagaagtttggagagagggccttcaaggcctgggcagtggcaaggctgagccagcggttcccaaaggcagagttcgcagaggtgtccaagctggtgaccgatctgacaaaggtgcacaccgagtgctgtcacggcgacctgctggagtgcgcagacgatagggcagatctggccaagtacatctgtgagaaccaggactctatctctagcaagctgaaggagtgctgtgagaagcccctgctggagaagagccactgcatcgccgaggtggagaatgacgagatgcctgccgatctgccatctctggccgccgacttcgtggagagcaaggacgtgtgcaagaactatgccgaggccaaggacgtgtttctgggcatgttcctgtatgagtacgccaggcgccaccccgattattccgtggtgctgctgctgcggctggccaagacctacgagacaaccctggagaagtgctgtgccgccgccgacccccacgagtgctacgcaaaggtgtttgacgagttcaagccactggtggaggagccccagaacctgatcaagcagaattgtgagctgttcgagcagctgggcgagtataagtttcagaatgccctgctggtgagatacacaaagaaggtgcctcaggtgtccaccccaacactggtggaggtgtctaggaacctgggcaaggtcggcagcaagtgctgtaagcacccagaggcaaagaggatgccttgcgccgaggactatctgtctgtggtgctgaaccagctgtgcgtgctgcacgagaagacccccgtgagcgatcgggtgaccaagtgctgtacagagtctctggtgaatagacggccctgcttcagcgccctggaggtggacgagacatacgtgccaaaggagtttaacgccgagacattcaccttccacgccgacatctgtaccctgtccgagaaggagagacagatcaagaagcagacagccctggtggagctggtgaagcacaagcctaaggccaccaaggagcagctgaaggccgtgatggacgattttgccgccttcgtggagaagtgctgtaaggccgacgataaggagacatgcttcgccgaggagggcaagaagctggtcgccgcttcacaggctgctctggggctgcatcaccaccaccaccactgataagcttggatcc

SEQ ID NO: 71 - DNA, 1788 bp, Artificial Sequence
  Description of Artificial Sequence: Synthetic polynucleotide
gaattcccgccgccaccatgaagtgggtgacctttattagcctgctgttcctgtttagttccgcatactcaagaggggtgtttagaagaagcgagagccctgtgaccatctccagggccggaaatgcaggagagctggtgtctcctctgctgctgccacctacacggagaaggcgccggagacacatccagggaccaggacctgtgctgaacctgccaagcgccgccgccgccccacccgtggccagagccccagaggcagcaggaggaggctccagatctgaggactatagctcctctccacacagcgccgccgccgccgcccggcccctggccgccgaggagaagcaggcccagtctctgcagcccagctcctctaggcgcagctcccactaccctgcagcagtgcagtcccaggctgccgccgagaggggagcctctgccaccgcaaagtctcgcgccatcagcatcctgcagaagaagccacgccaccagcagctgctgccctctctgtctagcttctttttcagccaccggctgcccgacatgaccgccatcatcaaggagatcgtgagcagaaataagcggcggtaccaggaggatggcttcgacctggatctgacatatatctaccccaacatcatcgccatgggatttcctgcagagcggctggagggcgtgtacagaaacaatatcgacgatgtggtgaggttcctggactccaagcacaagaaccactataagatctacaatctgtgcgccgagaggcactatgataccgccaagttcaactgtcgcgtggcccagtacccctttgaggaccacaatcctccacagctggagctgatcaagcctttctgcgaggacctggatcagtggctgtccgaggacgataatcacgtggcagcaatccactgcaaggcaggcaagggcaggacaggcgtgatgatctgtgcctatctgctgcaccgcggcaagttcctgaaggcccaggaggccctggacttttacggcgaggtgaggacccgcgataagaagggcgtgacaatcccaagccagcggcggtacgtgtactattactcctacctgctgaagaaccacctggactacaggccagtggccctgctgtttcacaagatgatgttcgagacaatccctatgttctccggcggcacatgcaacccacagtttgtggtgtgccagctgaaggtgaagatctattcctctaattctggcccaacccggagagaggataagttcatgtactttgagttcccacagccactgcccgtgtgcggcgacatcaaggtggagtttttccacaagcagaacaagatgctgaagaaggataagatgtttcacttctgggtgaatacctttttcatcccaggccccgaggagacatccgagaaggtggagaatggctctctgtgcgaccaggagatcgatagcatctgttccatcgagcgggccgacaacgataaggagtacctggtgctgaccctgacaaagaatgacctggataaggccaacaaggacaaggccaatagatacttcagccccaacttcaaggtgaagctgtacttcaccaagacagtggaggagccttccaatccagaggccagctcctctaccagcgtgacacctgacgtgtccgataacgagccagaccactatcggtactccgataccacagactctgatccagagaacgagccctttgacgaggatcagcacacccagatcacaaaggtgcatcaccaccaccaccactgataagcttggatcc

SEQ ID NO: 72 - DNA, 1773 bp, Artificial Sequence
  Description of Artificial Sequence: Synthetic polynucleotide
gaattcccgccgccaccatggagtttgggctgtcatgggtgttcctggtcgcaatcctgaaaggcgtgcagtgttccgagagccctgtgaccatctccagggccggaaatgcaggagagctggtgtctcctctgctgctgccacctacacggagaaggcgccggagacacatccagggaccaggacctgtgctgaacctgccaagcgccgccgccgccccacccgtggccagagccccagaggcagcaggaggaggctccagatctgaggactatagctcctctccacacagcgccgccgccgccgcccggcccctggccgccgaggagaagcaggcccagtctctgcagcccagctcctctaggcgcagctcccactaccctgcagcagtgcagtcccaggctgccgccgagaggggagcctctgccaccgcaaagtctcgcgccatcagcatcctgcagaagaagccacgccaccagcagctgctgccctctctgtctagcttctttttcagccaccggctgcccgacatgaccgccatcatcaaggagatcgtgagcagaaataagcggcggtaccaggaggatggcttcgacctggatctgacatatatctaccccaacatcatcgccatgggatttcctgcagagcggctggagggcgtgtacagaaacaatatcgacgatgtggtgaggttcctggactccaagcacaagaaccactataagatctacaatctgtgcgccgagaggcactatgataccgccaagttcaactgtcgcgtggcccagtacccctttgaggaccacaatcctccacagctggagctgatcaagcctttctgcgaggacctggatcagtggctgtccgaggacgataatcacgtggcagcaatccactgcaaggcaggcaagggcaggacaggcgtgatgatctgtgcctatctgctgcaccgcggcaagttcctgaaggcccaggaggccctggacttttacggcgaggtgaggacccgcgataagaagggcgtgacaatcccaagccagcggcggtacgtgtactattactcctacctgctgaagaaccacctggactacaggccagtggccctgctgtttcacaagatgatgttcgagacaatccctatgttctccggcggcacatgcaacccacagtttgtggtgtgccagctgaaggtgaagatctattcctctaattctggcccaacccggagagaggataagttcatgtactttgagttcccacagccactgcccgtgtgcggcgacatcaaggtggagtttttccacaagcagaacaagatgctgaagaaggataagatgtttcacttctgggtgaatacctttttcatcccaggccccgaggagacatccgagaaggtggagaatggctctctgtgcgaccaggagatcgatagcatctgttccatcgagcgggccgacaacgataaggagtacctggtgctgaccctgacaaagaatgacctggataaggccaacaaggacaaggccaatagatacttcagccccaacttcaaggtgaagctgtacttcaccaagacagtggaggagccttccaatccagaggccagctcctctaccagcgtgacacctgacgtgtccgataacgagccagaccactatcggtactccgataccacagactctgatccagagaacgagccctttgacgaggatcagcacacccagatcacaaaggtgcatcaccaccaccaccactgataagcttggatcc

SEQ ID NO: 73 - DNA, 1788 bp, Artificial Sequence
  Description of Artificial Sequence: Synthetic polynucleotide
gaattcccgccgccaccatgaagtgggtgacctttattagcctgctgttcctgtttagttccgcatactcaagaggggtgtttagaagaagcgagagccctgtgaccccatccagggccggaaatgcaggagagctggtgtctcctctgctgccaccacctacacggagaaggcgccggagacacatccagggaccaggacctgtgctgaacctgccaagcgccgccgccgccccacccgtggccagagccccagaggcagcaggaggaggctccagatctgaggactatagctcctctccacacagcgccgccgccgccgcccggcccccagccgccgaggagaagcaggcccagtctctgcagcccagctcctctaggcgcagctcccactaccctgcagcagtgcagtcccaggctgccgccgagaggggagcctctgccaccgcaaagtctcgcgccatcagcatcctgcagaagaagccacgccaccagcagctgctgccctctctgtctagcttctttttcagccaccggctgcccgacatgaccgccatcatcaaggagatcgtgagcagaaataagcggcggtaccaggaggatggcttcgacctggatctgacatatatctaccccaacatcatcgccatgggatttcctgcagagcggctggagggcgtgtacagaaacaatatcgacgatgtggtgaggttcctggactccaagcacaagaaccactataagatctacaatctgtgcgccgagaggcactatgataccgccaagttcaactgtcgcgtggcccagtacccctttgaggaccacaatcctccacagctggagctgatcaagcctttctgcgaggacctggatcagtggctgtccgaggacgataatcacgtggcagcaatccactgcaaggcaggcaagggcaggacaggcgtgatgatctgtgcctatctgctgcaccgcggcaagttcctgaaggcccaggaggccctggacttttacggcgaggtgaggacccgcgataagaagggcgtgacaatcccaagccagcggcggtacgtgtactattactcctacctgctgaagaaccacctggactacaggccagtggccctgctgtttcacaagatgatgttcgagacaatccctatgttctccggcggcacatgcaacccacagtttgtggtgtgccagctgaaggtgaagatctattcctctaattctggcccaacccggagagaggataagttcatgtactttgagttcccacagccactgcccgtgtgcggcgacatcaaggtggagtttttccacaagcagaacaagatgctgaagaaggataagatgtttcacttctgggtgaatacctttttcatcccaggccccgaggagacatccgagaaggtggagaatggctctctgtgcgaccaggagatcgatagcatctgttccatcgagcgggccgacaacgataaggagtacctggtgctgaccctgacaaagaatgacctggataaggccaacaaggacaaggccaatagatacttcagccccaacttcaaggtgaagctgtacttcaccaagacagtggaggagccttccaatccagaggccagctcctctaccagcgtgacacctgacgtgtccgataacgagccagaccactatcggtactccgataccacagactctgatccagagaacgagccctttgacgaggatcagcacacccagatcacaaaggtgcatcaccaccaccaccactgataagcttggatcc

SEQ ID NO: 74 - DNA, 2423 bp, Artificial Sequence
  Description of Artificial Sequence: Synthetic polynucleotide
gaattcccgccgccaccatggagtttgggctgtcctgggtctttctggtcgcaatcctgaagggcgtgcagtgttccgaatcccccgtcacaatctcaagggcaggaaatgcaggagagctggtgtccccactgctgctgccacctacccggagaaggcgccggagacacatccagggaccaggacctgtgctgaacctgccaagcgccgccgccgccccacccgtggcaagggcaccagaggcagcaggaggaggcagccgctccgaggactatagctcctctccccactccgccgcagcagcagcaaggcctctggcagccgaggagaagcaggcccagtctctgcagcccagctcctctaggcgcagctcccactaccctgcagcagtgcagagccaggcagcagcagagaggggagcatccgccaccgccaagtctcgcgccatcagcatcctgcagaagaagccaaggcaccagcagctgctgccttccctgtctagcttctttttctctcacaggctgcccgatatgaccgccatcatcaaggagatcgtgtcccgcaataagcggagatatcaggaggacggctttgacctggatctgacatatatctaccctaacatcatcgccatgggattcccagcagagcggctggagggcgtgtacagaaacaatatcgacgatgtggtgaggtttctggatagcaagcacaagaaccactataagatctacaatctgtgcgccgagcggcactatgacaccgccaagtttaactgtagagtggcccagtaccccttcgaggatcacaatcctccacagctggagctgatcaagcctttctgcgaggacctggatcagtggctgtccgaggacgataatcacgtggcagcaatccactgcaaggcaggcaagggaaggacaggcgtgatgatctgtgcctatctgctgcacaggggcaagtttctgaaggcccaggaggccctggacttctacggcgaggtgaggacccgcgataagaagggcgtgacaatcccttctcagcggcggtacgtgtactattacagctacctgctgaagaaccacctggactaccgcccagtggccctgctgtttcacaagatgatgttcgagaccatcccaatgttttctggcggcacatgcaacccccagttcgtggtgtgccagctgaaggtgaagatctattcctctaatagcggccccacccggagagaggacaagttcatgtactttgagttcccacagccactgcccgtgtgcggcgatatcaaggtggagtttttccacaagcagaacaagatgctgaagaaggacaagatgtttcacttctgggtgaatacctttttcatcccaggccccgaggagacaagcgagaaggtggagaatggctccctgtgcgaccaggagatcgattccatctgttctatcgagcgggccgacaacgataaggagtacctggtgctgaccctgacaaagaatgacctggataaggccaacaaggacaaggccaatagatacttcagccctaacttcaaggtgaagctgtactttaccaagacagtggaggagccctccaatcctgaggccagctcctctaccagcgtgacaccagacgtgtccgataacgagcccgaccactatcggtactccgataccacagactctgatcctgagaatgagccattcgacgaggatcagcacacccagatcacaaaggtgcaccaccaccaccaccacccttgcccagcaccagagctgctgggaggccctagcgtgtttctgttcccccctaagccaaaggataccctgatgatcagcagaaccccagaggtgacatgcgtggtggtggacgtgtcccacgaggaccccgaggtgaagttcaactggtacgtggacggcgtggaggtgcacaatgccaagacaaagccccgggaggagcagtataactctacctacagagtggtgagcgtgctgacagtgctgcaccaggattggctgaacggcaaggagtacaagtgcaaggtgtctaataaggccctgcctgccccaatcgagaagaccatcagcaaggcaaagggacagccaagggagccacaggtgtatacactgccaccctcccgcgatgagctgaccaagaatcaggtgtctctgacatgtctggtgaagggcttttacccttccgacatcgccgtggagtgggagtctaacggccagccagagaacaattataagaccacacctccagtgctggacagcgatggctcctttttcctgtactctaagctgaccgtggacaagagcagatggcagcagggcaacgtgttctcttgcagcgtgatgcacgaggcactgcacaatcactacacccagaagtcactgtccctgtcccccggataaggatcc

SEQ ID NO: 75 - DNA, 2466 bp, Artificial Sequence
  Description of Artificial Sequence: Synthetic polynucleotide
gaattcccgccgccaccatggagtttgggctgtcctgggtctttctggtcgcaatcctgaagggcgtgcagtgttccgaatcccccgtcacaatctcaagggcaggaaatgcaggagagctggtgtccccactgctgctgccacctacccggagaaggcgccggagacacatccagggaccaggacctgtgctgaacctgccaagcgccgccgccgccccacccgtggcaagggcaccagaggcagcaggaggaggcagccgctccgaggactatagctcctctccccactccgccgcagcagcagcaaggcctctggcagccgaggagaagcaggcccagtctctgcagcccagctcctctaggcgcagctcccactaccctgcagcagtgcagagccaggcagcagcagagaggggagcatccgccaccgccaagtctcgcgccatcagcatcctgcagaagaagccaaggcaccagcagctgctgccttccctgtctagcttctttttctctcacaggctgcccgatatgaccgccatcatcaaggagatcgtgtcccgcaataagcggagatatcaggaggacggctttgacctggatctgacatatatctaccctaacatcatcgccatgggattcccagcagagcggctggagggcgtgtacagaaacaatatcgacgatgtggtgaggtttctggatagcaagcacaagaaccactataagatctacaatctgtgcgccgagcggcactatgacaccgccaagtttaactgtagagtggcccagtaccccttcgaggatcacaatcctccacagctggagctgatcaagcctttctgcgaggacctggatcagtggctgtccgaggacgataatcacgtggcagcaatccactgcaaggcaggcaagggaaggacaggcgtgatgatctgtgcctatctgctgcacaggggcaagtttctgaaggcccaggaggccctggacttctacggcgaggtgaggacccgcgataagaagggcgtgacaatcccttctcagcggcggtacgtgtactattacagctacctgctgaagaaccacctggactaccgcccagtggccctgctgtttcacaagatgatgttcgagaccatcccaatgttttctggcggcacatgcaacccccagttcgtggtgtgccagctgaaggtgaagatctattcctctaatagcggccccacccggagagaggacaagttcatgtactttgagttcccacagccactgcccgtgtgcggcgatatcaaggtggagtttttccacaagcagaacaagatgctgaagaaggacaagatgtttcacttctgggtgaatacctttttcatcccaggccccgaggagacaagcgagaaggtggagaatggctccctgtgcgaccaggagatcgattccatctgttctatcgagcgggccgacaacgataaggagtacctggtgctgaccctgacaaagaatgacctggataaggccaacaaggacaaggccaatagatacttcagccctaacttcaaggtgaagctgtactttaccaagacagtggaggagccctccaatcctgaggccagctcctctaccagcgtgacaccagacgtgtccgataacgagcccgaccactatcggtactccgataccacagactctgatcctgagaatgagccattcgacgaggatcagcacacccagatcacaaaggtgcaccaccaccaccaccacgagccaaagagctccgataagacccacacatgcccaccttgcccagcaccagagctgctgggaggccctagcgtgtttctgttcccccctaagccaaaggataccctgatgatcagcagaaccccagaggtgacatgcgtggtggtggacgtgtcccacgaggaccccgaggtgaagttcaactggtacgtggacggcgtggaggtgcacaatgccaagacaaagccccgggaggagcagtatcagtctacctacagagtggtgagcgtgctgacagtgctgcaccaggattggctgaacggcaaggagtacaagtgcaaggtgtctaataaggccctgcctgccccaatcgagaagaccatcagcaaggcaaagggacagccaagggagccacaggtgtatacactgccaccctcccgcgatgagctgaccaagaatcaggtgtctctgacatgtctggtgaagggcttttacccttccgacatcgccgtggagtgggagtctaacggccagccagagaacaattataagaccacacctccagtgctggacagcgatggctcctttttcctgtactctaagctgaccgtggacaagagcagatggcagcagggcaacgtgttctcttgcagcgtgatgcacgaggcactgcacaatcactacacccagaagtcactgtccctgtcccccggataataagcttggatcc

SEQ ID NO: 76 - DNA, 2420 bp, Artificial Sequence
  Description of Artificial Sequence: Synthetic polynucleotide
gaattcccgccgccaccatggagtttgggctgtcctgggtcttcctggtcgcaatcctgaaaggcgtgcagtgtccctgtcccgcacctgagctgctgggcggacctagcgtgtttctgttcccccctaagccaaaggataccctgatgatctctcggacccctgaggtgacatgcgtggtggtggacgtgagccacgaggaccccgaggtgaagttcaactggtacgtggacggcgtggaggtgcacaatgccaagacaaagcccagggaggagcagtataactctacctaccgcgtggtgagcgtgctgacagtgctgcaccaggactggctgaacggcaaggagtacaagtgcaaggtgtccaataaggccctgcccgcccctatcgagaagaccatctctaaggcaaagggacagccaagggagcctcaggtgtatacactgccacccagccgcgatgagctgaccaagaatcaggtgtccctgacatgtctggtgaagggcttttacccaagcgacatcgcagtggagtgggagtccaacggacagcccgagaacaattataagaccacacctccagtgctggacagcgatggctccttctttctgtacagcaagctgaccgtggataagtccaggtggcagcagggcaacgtgttcagctgttccgtgatgcacgaggccctgcacaatcactacacacagaagtctctgagcctgtccccaggaggaggaggaggctctatcagcagggcaggaaatgcaggagagctggtgagcccactgctgctgccacctacccggagaaggcgccggagacacatccagggaccaggacccgtgctgaacctgccatccgccgcagcagcaccaccagtggccagggcccctgaggccgccggcggcggctcccgctctgaggactatagctcctctccccacagcgccgcagcagcagcaaggcctctggcagcagaggagaagcaggcacagtccctgcagcctagctcctctaggcgcagctcccactacccagcagcagtgcagtctcaggcagcagcagagaggggagcaagcgccaccgccaagtccagagccatctctatcctgcagaagaagcctagacaccagcagctgctgccatctctgtctagcttctttttcagccacaggctgcccgatatgaccgccatcatcaaggagatcgtgagccgcaataagcggagatatcaggaggacggctttgacctggatctgacatatatctacccaaacatcatcgccatgggattcccagcagagcggctggagggcgtgtacagaaacaatatcgacgatgtggtgaggtttctggattccaagcacaagaaccactataagatctacaatctgtgcgccgagcggcactatgacaccgccaagtttaactgtagagtggcccagtaccccttcgaggatcacaatcctccacagctggagctgatcaagcctttctgcgaggacctggatcagtggctgagcgaggacgataatcacgtggcagcaatccactgcaaggcaggcaagggaaggacaggcgtgatgatctgtgcctatctgctgcacaggggcaagtttctgaaggcccaggaggccctggacttctacggcgaggtgaggacccgcgataagaagggcgtgacaatcccttcccagcggcggtacgtgtactattactcttacctgctgaagaaccacctggactaccgcccagtggccctgctgtttcacaagatgatgttcgagaccatcccaatgtttagcggcggcacatgcaacccccagttcgtggtgtgccagctgaaggtgaagatctattcctctaattccggccccacccggagagaggacaagtttatgtactttgagttccctcagccactgcccgtgtgcggcgatatcaaggtggagtttttccacaagcagaacaagatgctgaagaaggacaagatgtttcacttctgggtgaatacctttttcatccctggcccagaggagacatccgagaaggtggagaatggctctctgtgcgaccaggagatcgattctatctgtagcatcgagcgggccgacaacgataaggagtacctggtgctgaccctgacaaagaatgacctggataaggccaacaaggacaaggccaatagatatttttctcccaacttcaaggtgaagctgtacttcaccaagacagtggaggagccatccaatcccgaggccagctcctctacctccgtgacacccgacgtgtctgataacgagcctgaccactataggtacagcgataccacagactccgatcctgagaacgagccatttgacgaagaccagcatactcagattactaaagtccaccatcaccaccaccattgaggatcc

SEQ ID NO: 77 - DNA, 3018 bp, Artificial Sequence
  Description of Artificial Sequence: Synthetic polynucleotide
gaattcccgccgccaccatgaagtgggtcacctttatttccctgctgttcctgtttagctccgcttactcaagaggcgtgttccgacggtatccttatgatgtccccgactacgcctgcatgaccgccatcatcaaggagatcgtgagccggaacaagcggagatatcaggaggatggctttgacctggatctgacatacatctatccaaatatcatcgccatgggattcccagcagagcggctggagggcgtgtacagaaacaatatcgacgatgtggtgagatttctggactccaagcacaagaaccactacaagatctataatctgtgcgccgagaggcactacgacaccgccaagtttaactgtcgcgtggcccagtatcctttcgaggatcacaatccccctcagctggagctgatcaagccattctgtgaggacctggatcagtggctgagcgaggacgataaccacgtggcagcaatccactgcaaggcaggcaagggaaggacaggcgtgatgatctgtgcctacctgctgcacaggggcaagtttctgaaggcccaggaggccctggacttctatggcgaggtgcggaccagagataagaagggcgtgacaatcccaagccagaggcgctacgtgtactattactcctatctgctgaagaatcacctggattacaggcccgtggccctgctgtttcacaagatgatgttcgagacaatccccatgttttctggcggcacatgcaaccctcagttcgtggtgtgccagctgaaggtgaagatctacagctccaatagcggccccacccggagagaggacaagttcatgtattttgagttcccacagccactgcccgtgtgcggcgatatcaaggtggagttctttcacaagcagaacaagatgctgaagaaggacaagatgtttcacttctgggtgaataccttctttatcccaggccccgaggagacaagcgagaaggtggagaacggctccctgtgcgaccaggagatcgattccatctgttctatcgagagggccgacaacgataaggagtacctggtgctgaccctgacaaagaatgacctggataaggccaacaaggacaaggccaatcgctacttttctccaaacttcaaggtgaagctgtacttcaccaagacagtggaggagccaagcaatcccgaggcctctagctccacctctgtgacaccagacgtgagcgataacgagcccgaccactacaggtattccgataccacagactctgatcccgagaacgagcctttcgacgaggatcagcacacccagatcacaaaagtgggaggaggaggcagccgcgcaggaaatgcaggagagctggtgtccccactgctgctgccaccaaccaggcgccggagaaggcgccacatccagggacctggaccagtgctgaacctgccaagcgccgccgccgcccctccagtggcaagggcaccagaggcagcaggaggaggctctagaagcgaggactactctagctccccacactccgccgcagcagcagccaggcccctggcagccgaggagaagcaggcccagtctctgcagccctctagctcccggagatctagccactatcctgccgccgtgcagtctcaggcagcagcagagaggggagcaagcgccaccgccaagtctagagccatcagcatcctgcagaagaagcctcgccaccagcagctgctgccatctctgtcctctttctttttcagccaccggctgcctgatatgactgctatcatcaaggaaatcgtgagcagaaacaagaggcgctaccaggaagacggattcgacctggatctgacctatatctatcctaacattattgctatgggctttccagcagagaggctggagggcgtgtatcgcaataacatcgacgatgtggtgcggtttctggatagcaaacataaaaatcattataaaatctataatctgtgcgctgaaagacattatgatactgctaagtttaactgccgcgtggcccagtatcccttcgaggaccataaccctccacagctggaactgatcaagcctttctgcgaagacctggaccagtggctgtctgaagatgacaatcatgtcgccgccattcattgtaaggcaggcaagggcagaaccggcgtgatgatttgcgcctacctgctgcaccgcggcaagtttctgaaagctcaagaggccctggacttctatggtgaggtgaggacccgcgacaaaaagggcgtgacaatcccttcccagcggagatacgtgtattactattcttatctgctgaagaaccacctggactacagaccagtggccctgctgttccataaaatgatgtttgagacaatccctatgttttccggcggcacatgcaatccacagtttgtggtgtgccagctgaaggtaaagatctacagctccaactctggaccaaccaggagggaggataagttcatgtacttcgagttcccacagcctctgcccgtgtgcggcgacatcaaggtggagtttttccataaacaaaacaagatgctgaagaaggataaaatgttccatttttgggtgaatacctttttcatccccggccctgaggagacatccgaaaaagtggagaacggctctctgtgcgatcaggaaatcgatagcatctgttccatcgagagagctgataatgacaaagaatacctggtgctgaccctgacgaaaaacgacctggacaaagctaacaaggataaggccaatagatactttagccccaatttcaaggtgaagctgtatttcaccaaaaccgtggaggagccttccaacccagaggcctcttcctccacctccgtgacacccgacgtgtctgataatgagcctgaccactacagatatagcgataccacagactccgatcctgagaatgagccatttgacgaggaccagcatacccagattactaaagtgcatcatcaccaccaccattgataagcttggatcc

SEQ ID NO: 78 - DNA, 3509 bp, Artificial Sequence
  Description of Artificial Sequence: Synthetic polynucleotide
gaattcccgccgccaccatgaaatgggtcacctttatcagtctgctgttcctgttctccagtgcttattctaggggcgtgtttaggcgggatgctcacaagtccgaggtggcccaccgctttaaggatctgggcgaggagaacttcaaggccctggtgctgatcgcctttgcccagtacctgcagcagtgccccttcgaggaccacgtgaagctggtgaacgaggtgaccgagtttgccaagacatgcgtggccgacgagagcgccgagaattgtgataagtccctgcacaccctgttcggcgataagctgtgcaccgtggccacactgcgcgagacatatggcgagatggccgactgctgtgccaagcaggagccagagcggaacgagtgctttctgcagcacaaggacgataacccaaatctgcccagactggtgaggcccgaggtggacgtgatgtgcaccgcctttcacgataatgaggagacattcctgaagaagtacctgtatgagatcgcccggagacacccttacttctatgccccagagctgctgttctttgccaagagatacaaggccgcctttaccgagtgctgtcaggcagcagataaggcagcatgcctgctgccaaagctggacgagctgagagatgagggcaaggccagctccgccaagcagaggctgaagtgtgcctccctgcagaaatttggcgagcgcgccttcaaggcctgggcagtggcaaggctgtcccagcggtttccaaaggccgagttcgccgaggtgtctaagctggtgaccgacctgacaaaggtgcacaccgagtgctgtcacggcgacctgctggagtgcgcagacgatagggcagatctggccaagtacatctgtgagaaccaggactccatctctagcaagctgaaggagtgctgtgagaagcccctgctggagaagtctcactgcatcgccgaggtggagaacgacgagatgccagcagatctgcctagcctggcagcagacttcgtggagtccaaggacgtgtgcaagaattacgccgaggccaaggacgtgttcctgggcatgttcctgtacgagtatgccaggcgccaccctgactacagcgtggtgctgctgctgcgcctggccaagacctatgagaccacactggagaagtgctgtgccgccgccgatccacacgagtgctatgccaaggtgtttgacgagttcaagcccctggtggaggagcctcagaacctgatcaagcagaattgtgagctgttcgagcagctgggcgagtacaagtttcagaacgccctgctggtgcggtatacaaagaaggtgccacaggtgtctacccccacactggtggaggtgagcagaaatctgggcaaggtcggctccaagtgctgtaagcaccctgaggccaagaggatgccatgcgccgaggattacctgtctgtggtgctgaatcagctgtgcgtgctgcacgagaagacccccgtgagcgacagagtgaccaagtgctgtacagagtccctggtgaaccggagaccttgcttctctgccctggaggtggatgagacatatgtgccaaaggagtttaatgccgagacctttacattccacgccgacatctgtaccctgagcgagaaggagaggcagatcaagaagcagacagccctggtggagctggtgaagcacaagcctaaggccaccaaggagcagctgaaggccgtgatggacgattttgccgccttcgtggagaagtgctgtaaggccgacgataaggagacatgcttcgcagaggagggcaagaagctggtggcagcatctcaggccgccctgggactgatcagcagagcaggaaacgcaggagagctggtgtccccactgctgctgccacctaccaggcgccggagaaggcgccacatccagggaccaggacccgtgctgaatctgccaagcgccgccgccgccccacccgtggcaagagcaccagaggcagcaggaggaggctctaggagcgaggactactcctctagccctcacagcgccgcagcagcagcaaggccactggcagcagaggagaagcaggcacagtccctgcagccatcctctagccggagatcctctcactatcctgccgccgtgcagagccaggcagcagcagagaggggagcatccgccaccgccaagtcccgggccatctctatcctgcagaagaagccacgccaccagcagctgctgccctctctgagctccttctttttcagccacaggctgccagatggaggaggaggctccatggaggagccacagtctgaccccagcgtggagcctccactgtctcaggagacattcagcgacctgtggaagctgctgcccgagaacaatgtgctgagccctctgccatcccaggccatggacgatctgatgctgagccctgacgatatcgagcagtggtttaccgaggaccccggacctgatgaggcacctagaatgccagaggcagcaccacctgtggcaccagcaccagccgcccctacaccagccgcccccgcccctgccccatcctggcccctgtctagctccgtgccttcccagaagacctaccagggctcttatggctttaggctgggcttcctgcactccggcacagccaagtctgtgacctgcacatacagcccagccctgaacaagatgttctgccagctggccaagacctgtcccgtgcagctgtgggtggattctaccccaccacctggaacacgggtgagagcaatggcaatctataagcagagccagcacatgacagaggtggtgaggcgctgcccacaccacgagcggtgttccgactctgatggactggcaccaccacagcacctgatcagggtggagggcaacctgcgggtggagtacctggacgatagaaataccttcaggcacagcgtggtggtgccctatgagcctccagaagtgggctccgactgcaccacaatccactacaactatatgtgcaattctagctgtatgggcggcatgaaccggagacctatcctgaccatcatcacactggaggattcctctggcaacctgctgggcagaaattcctttgaggtgagggtgtgcgcatgtcctggaagggacaggaggaccgaggaggagaatctgcggaagaagggagagccacaccacgagctgccacctggcagcaccaagcgcgccctgcccaacaatacaagctcctctccccagcccaagaagaagcctctggatggcgagtacttcacactgcagatcaggggccgcgagcggtttgagatgttccgggagctgaatgaggccctggagctgaaggacgcacaggcaggcaaggagcctggaggctctagagcccacagctcccacctgaagagcaagaagggccagagcacctccaggcacaagaaactgatgttcaaaactgagggacccgattccgaccaccaccaccaccaccactaaaagcttggatcc

SEQ ID NO: 79 - protein, 580 aa, Artificial Sequence
  Description of Artificial Sequence: Synthetic polypeptide
MKRMKSLAAALTVAGAMLAAPVATASESPVTISRAGNAGELVSPLLLPPTRRRRRRHIQGPGPVLNLPSAAAAPPVARAPEAAGGGSRSEDYSSSPHSAAAAARPLAAEEKQAQSLQPSSSRRSSHYPAAVQSQAAAERGASATAKSRAISILQKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKV

SEQ ID NO: 80 - protein, 591 aa, Artificial Sequence
  Description of Artificial Sequence: Synthetic polypeptide
MFNNRIRTAALAGAIAISTAASGVAIPAFAAETNPTSESPVTISRAGNAGELVSPLLLPPTRRRRRRHIQGPGPVLNLPSAAAAPPVARAPEAAGGGSRSEDYSSSPHSAAAAARPLAAEEKQAQSLQPSSSRRSSHYPAAVQSQAAAERGASATAKSRAISILQKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKV

SEQ ID NO: 81 - protein, 594 aa, Artificial Sequence
  Description of Artificial Sequence: Synthetic polypeptide
MNNNDLFQASRRRFLAQLGGLTVAGMLGPSLLTPRRATASESPVTISRAGNAGELVSPLLLPPTRRRRRRHIQGPGPVLNLPSAAAAPPVARAPEAAGGGSRSEDYSSSPHSAAAAARPLAAEEKQAQSLQPSSSRRSSHYPAAVQSQAAAERGASATAKSRAISILQKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKV

SEQ ID NO: 82 - protein, 586 aa, Artificial Sequence
  Description of Artificial Sequence: Synthetic polypeptide
MKLSKRGLFWLLGLVSFAILLLFSQPLGAQASESPVTISRAGNAGELVSPLLLPPTRRRRRRHIQGPGPVLNLPSAAAAPPVARAPEAAGGGSRSEDYSSSPHSAAAAARPLAAEEKQAQSLQPSSSRRSSHYPAAVQSQAAAERGASATAKSRAISILQKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKV

SEQ ID NO: 83 - protein, 582 aa, Artificial Sequence
  Description of Artificial Sequence: Synthetic polypeptide
MKEVRFWGLLLGLFVCLGAVIPLVSKASESPVTISRAGNAGELVSPLLLPPTRRRRRRHIQGPGPVLNLPSAAAAPPVARAPEAAGGGSRSEDYSSSPHSAAAAARPLAAEEKQAQSLQPSSSRRSSHYPAAVQSQAAAERGASATAKSRAISILQKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKV

SEQ ID NO: 84 - protein, 1246 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGPAALKAATNRRKKRALDAAYISRAGNAGELVSPLLLPPTRRRRRRHIQGPGPVLNLPSAAAAPPVARAPEAAGGGSRSEDYSSSPHSAAAAARPLAAEEKQAQSLQPSSSRRSSHYPAAVQSQAAAERGASATAKSRAISILQKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKVHHHHHH

SEQ ID NO: 85 - protein, 613 aa, Artificial Sequence
  Description of Artificial Sequence: Synthetic polypeptide
MRFPSIFTAVLFAASSALAAPVNTTTEDELEGDFDVAVLPFSASIAAKEEGVSLEKRMSESPVTISRAGNAGELVSPLLLPPTRRRRRRHIQGPGPVLNLPSAAAAPPVARAPEAAGGGSRSEDYSSSPHSAAAAARPLAAEEKQAQSLQPSSSRRSSHYPAAVQSQAAAERGASATAKSRAISILQKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKV

SEQ ID NO: 86 - DNA, 2097 bp, Artificial Sequence
  Description of Artificial Sequence: Synthetic polynucleotide
gaattcgccgccaccatggtttcggcaatcgtcctctacgttctcctggctgctgcggctcattcggctttcgcctcggacaaaatcatccacctcactgacgactccttcgacactgacgtcctgaaggctgacggtgctatcctggtggacttctgggcccactggtgcggtccatgcaagatgatcgctccaatcctggacgagatcgccgacgaataccagggcaagctgactgtcgctaagctgaacatcgaccacaacccaggtaccgccccaaagtacggtatccgtggtatccccactctgctgctgttcaagaacggagaagtggccgctaccaaggtcggtgctctgtcaaagggacagctgaaggagttcctggacgctaacctggctgagaacctgtacttccagggtatcagcagagctggcaacgccggtgaactggtctccccactgctgctgccacctacccgtagacgcaggcgtagacacatccagggaccaggtcctgtcctgaacctgccttcagctgctgccgctcctccagtcgccagagctccagaggctgccggaggcggttctcgttccgaggactactcctctagccctcactccgctgccgctgctgctagaccactggccgctgaagagaagcaggcccagagcctgcagccatccagctcaaggcgtagctctcactaccctgctgccgtccagtcacaggctgctgccgaaagaggcgcttccgccaccgctaagtccagagctatctccatcctgcagaagaagccacgtcaccagcagctgctgccctctctgtccagcttcttcttctcacaccgtctgccagacatgaccgccatcatcaaggagatcgtcagcagaaacaagcgtagataccaggaggacggtttcgacctggacctgacttacatctacccaaacatcatcgctatgggtttccccgctgaaaggctggagggtgtctaccgtaacaacatcgacgacgtcgtgagattcctggacagcaagcacaagaaccactacaagatctacaacctgtgcgctgagagacactacgacaccgctaagttcaactgccgtgtggctcagtacccattcgaggaccacaacccccctcagctggagctgatcaagcctttctgcgaagacctggaccagtggctgtccgaggacgacaaccacgtggctgccatccactgcaaggctggcaagggtaggaccggtgtgatgatctgcgcttacctgctgcaccgcggaaagttcctgaaggctcaggaggccctggacttctacggcgaagtgagaacccgtgacaagaagggtgtgaccatcccttcccagcgtagatacgtgtactactacagctacctgctgaagaaccacctggactacagacccgtggccctgctgttccacaagatgatgttcgagactatccccatgttctccggaggtacctgcaacccacagttcgtggtctgccagctgaaggtgaagatctactcctctaactccggacctactagacgtgaagacaagttcatgtacttcgagttcccccagccactgcctgtgtgcggtgacatcaaggtggagttcttccacaagcagaacaagatgctgaagaaggacaagatgttccacttctgggtcaacaccttcttcatccctggtccagaagaaacttccgaaaaggtcgagaacggtagcctgtgcgaccaggagatcgactccatctgctccatcgaacgtgccgacaacgacaaggagtacctggtgctgactctgaccaagaacgacctggacaaggctaacaaggacaaggccaacagatacttctcccccaacttcaaggtgaagctgtacttcactaagaccgtcgaagagccatccaacccagaagccagcagctccacctccgtcactcctgacgtctcagacaacgaaccagaccactacagatacagcgacaccactgactccgaccccgagaacgagccattcgacgaggaccaacatactcagattaccaaagttcatcatcatcatcaccattaatgaaagctt

SEQ ID NO: 87 - protein, 690 aa, Artificial Sequence
  Description of Artificial Sequence: Synthetic polypeptide
MVSAIVLYVLLAAAAHSAFASDKIIHLTDDSFDTDVLKADGAILVDFWAHWCGPCKMIAPILDEIADEYQGKLTVAKLNIDHNPGTAPKYGIRGIPTLLLFKNGEVAATKVGALSKGQLKEFLDANLAENLYFQGISRAGNAGELVSPLLLPPTRRRRRRHIQGPGPVLNLPSAAAAPPVARAPEAAGGGSRSEDYSSSPHSAAAAARPLAAEEKQAQSLQPSSSRRSSHYPAAVQSQAAAERGASATAKSRAISILQKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKVHHHHHH

SEQ ID NO: 88 - protein, 403 aa, Mus sp.
MTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHSQITKV

SEQ ID NO: 89 - protein, 555 aa, Mus sp.
SESPVTIARAGNAGELLSPLLLPPTRRRRRRHVQGPGPVLSLPSAAAAPPLARAPEAAGGGSRCEDYPSSPHSAASAARPLAAEEKQAQSLQPSSSRRSSHYPAAVQGQAAAERGASATAKSRAISILQKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHSQITKV

SEQ ID NO: 90 - protein, 584 aa, Unknown
  Description of Unknown: Mature simian serum albumin sequence
DTHKSEVAHRFKDLGEEHFKGLVLVAFSQYLQQCPFEEHVKLVNEVTEFAKTCVADESAENCDKSLHTLFGDKLCTVATLRETYGEMADCCAKQEPERNECFLQHKDDNPNLPPLVRPEVDVMCTAFHDNEATFLKKYLYEVARRHPYFYAPELLFFAARYKAAFAECCQAADKAACLLPKLDELRDEGKASSAKQRLKCASLQKFGDRAFKAWAVARLSQKFPKAEFAEVSKLVTDLTKVHTECCHGDLLECADDRADLAKYMCENQDSISSKLKECCDKPLLEKSHCLAEVENDEMPADLPSLAADYVESKDVCKNYAEAKDVFLGMFLYEYARRHPDYSVMLLLRLAKAYEATLEKCCAAADPHECYAKVFDEFQPLVEEPQNLVKQNCELFEQLGEYKFQNALLVRYTKKVPQVSTPTLVEVSRNLGKVGAKCCKLPEAKRMPCAEDYLSVVLNRLCVLHEKTPVSEKVTKCCTESLVNRRPCFSALELDEAYVPKAFNAETFTFHADMCTLSEKEKQVKKQTALVELVKHKPKATKEQLKGVMDNFAAFVEKCCKADDKEACFAEEGPKFVAASQAALA

SEQ ID NO: 91 - protein, 584 aa, Rattus sp.
EAHKSEIAHRFKDLGEQHFKGLVLIAFSQYLQKCPYEEHIKLVQEVTDFAKTCVADENAENCDKSIHTLFGDKLCAIPKLRDNYGELADCCAKQEPERNECFLQHKDDNPNLPPFQRPEAEAMCTSFQENPTSFLGHYLHEVARRHPYFYAPELLYYAEKYNEVLTQCCTESDKAACLTPKLDAVKEKALVAAVRQRMKCSSMQRFGERAFKAWAVARMSQRFPNAEFAEITKLATDVTKINKECCHGDLLECADDRAELAKYMCENQATISSKLQACCDKPVLQKSQCLAEIEHDNIPADLPSIAADFVEDKEVCKNYAEAKDVFLGTFLYEYSRRHPDYSVSLLLRLAKKYEATLEKCCAEGDPPACYGTVLAEFQPLVEEPKNLVKTNCELYEKLGEYGFQNAVLVRYTQKAPQVSTPTLVEAARNLGRVGTKCCTLPEAQRLPCVEDYLSAILNRLCVLHEKTPVSEKVTKCCSGSLVERRPCFSALTVDETYVPKEFKAETFTFHSDICTLPDKEKQIKKQTALAELVKHKPKATEDQLKTVMGDFAQFVDKCCKAADKDNCFATEGPNLVARSKEALA

SEQ ID NO: 92 - protein, 584 aa, Mus sp.
EAHKSEIAHRYNDLGEQHFKGLVLIAFSQYLQKCSYDEHAKLVQEVTDFAKTCVADESAANCDKSLHTLFGDKLCAIPNLRENYGELADCCTKQEPERNECFLQHKDDNPSLPPFERPEAEAMCTSFKENPTTFMGHYLHEVARRHPYFYAPELLYYAEQYNEILTQCCAEADKESCLTPKLDGVKEKALVSSVRQRMKCSSMQKFGERAFKAWAVARLSQTFPNADFAEITKLATDLTKVNKECCHGDLLECADDRAELAKYMCENQATISSKLQTCCDKPLLKKAHCLSEVEHDTMPADLPAIAADFVEDQEVCKNYAEAKDVFLGTFLYEYSRRHPDYSVSLLLRLAKKYEATLEKCCAEANPPACYGTVLAEFQPLVEEPKNLVKTNCDLYEKLGEYGFQNAILVRYTQKAPQVSTPTLVEAARNLGRVGTKCCTLPEDQRLPCVEDYLSAILNRVCLLHEKTPVSEHVTKCCSGSLVERRPCFSALTVDETYVPKEFKAETFTFHSDICTLPEKEKQIKKQTALAELVKHKPKATAEQLKTVMDDFAQFLDTCCKAADKDTCFSTEGPNLVTRCKDALA

SEQ ID NO: 93 - protein, 24 aa, Homo sapiens
MKWVTFISLLFLFSSAYSRGVFRR

SEQ ID NO: 94 - protein, 24 aa, Unknown
  Description of Unknown: Simian serum albumin signal sequence
MKWVTFISLLFLFSSAYSRGVFRR

SEQ ID NO: 95 - protein, 24 aa, Rattus sp.
MKWVTFLLLLFISGSAFSRGVFRR

SEQ ID NO: 96 - protein, 24 aa, Mus sp.
MKWVTFLLLLFVSGSAFSRGVFRR

SEQ ID NO: 97 - protein, 22 aa, Mus sp.
MRRNQLPTPAFLLLFLLLPRDA

SEQ ID NO: 98 - protein, 19 aa, Mus sp.
MLSLRVTCLILSVASTVWT

SEQ ID NO: 99 - protein, 24 aa, Mus sp.
MTPSISWGLLLLAGLCCLVPSFLA

SEQ ID NO: 100 - protein, 20 aa, Mus sp.
METDTLLLWVLLLWVPGSTG

SEQ ID NO: 101 - protein, 19 aa, Homo sapiens
MEFGLSWVFLVAILKGVQC

SEQ ID NO: 102 - protein, 20 aa, Homo sapiens
MVLQTQVFISLLLWISGAYG

SEQ ID NO: 103 - protein, 16 aa, Homo sapiens
MPLLLLLPLLWAGALA

SEQ ID NO: 104 - protein, 21 aa, Artificial Sequence
  Description of Artificial Sequence: Synthetic peptide
MWWRLWWLLLLLLLLWPMVWA

SEQ ID NO: 105 - protein, 23 aa, Artificial Sequence
  Description of Artificial Sequence: Synthetic peptide
MWWRLWWLLLLLLLLWPMVWAAA

SEQ ID NO: 106 - protein, 5 aa, Artificial Sequence
  Description of Artificial Sequence: Synthetic peptide
GGAGS

SEQ ID NO: 107 - protein, 4 aa, Artificial Sequence
  Description of Artificial Sequence: Synthetic peptide
GFVG

SEQ ID NO: 108 - protein, 5 aa, Artificial Sequence
  Description of Artificial Sequence: Synthetic peptide
FGFVG

SEQ ID NO: 109 - protein, 1168 aa, Artificial Sequence
  Description of Artificial Sequence: Synthetic polypeptide
MRRNQLPTPAFLLLFLLLPRDASESPVTISRAGNAGELVSPLLLPPTRRRRRRHIQGPGPVLNLPSAAAAPPVARAPEAAGGGSRSEDYSSSPHSAAAAARPLAAEEKQAQSLQPSSSRRSSHYPAAVQSQAAAERGASATAKSRAISILQKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKVDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 110 - protein, 1165 aa, Artificial Sequence
  Description of Artificial Sequence: Synthetic polypeptide
MLSLRVTCLILSVASTVWTSESPVTISRAGNAGELVSPLLLPPTRRRRRRHIQGPGPVLNLPSAAAAPPVARAPEAAGGGSRSEDYSSSPHSAAAAARPLAAEEKQAQSLQPSSSRRSSHYPAAVQSQAAAERGASATAKSRAISILQKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKVDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 111 - protein, 1170 aa, Artificial Sequence
  Description of Artificial Sequence: Synthetic polypeptide
MTPSISWGLLLLAGLCCLVPSFLASESPVTISRAGNAGELVSPLLLPPTRRRRRRHIQGPGPVLNLPSAAAAPPVARAPEAAGGGSRSEDYSSSPHSAAAAARPLAAEEKQAQSLQPSSSRRSSHYPAAVQSQAAAERGASATAKSRAISILQKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKVDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 112 - protein, 1166 aa, Artificial Sequence
  Description of Artificial Sequence: Synthetic polypeptide
METDTLLLWVLLLWVPGSTGSESPVTISRAGNAGELVSPLLLPPTRRRRRRHIQGPGPVLNLPSAAAAPPVARAPEAAGGGSRSEDYSSSPHSAAAAARPLAAEEKQAQSLQPSSSRRSSHYPAAVQSQAAAERGASATAKSRAISILQKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKVDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 113 - protein, 1166 aa, Artificial Sequence
  Description of Artificial Sequence: Synthetic polypeptide
MVLQTQVFISLLLWISGAYGSESPVTISRAGNAGELVSPLLLPPTRRRRRRHIQGPGPVLNLPSAAAAPPVARAPEAAGGGSRSEDYSSSPHSAAAAARPLAAEEKQAQSLQPSSSRRSSHYPAAVQSQAAAERGASATAKSRAISILQKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKVDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 114 - protein, 1162 aa, Artificial Sequence
  Description of Artificial Sequence: Synthetic polypeptide
MPLLLLLPLLWAGALASESPVTISRAGNAGELVSPLLLPPTRRRRRRHIQGPGPVLNLPSAAAAPPVARAPEAAGGGSRSEDYSSSPHSAAAAARPLAAEEKQAQSLQPSSSRRSSHYPAAVQSQAAAERGASATAKSRAISILQKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKVDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 115 - protein, 1167 aa, Artificial Sequence
  Description of Artificial Sequence: Synthetic polypeptide
MWWRLWWLLLLLLLLWPMVWASESPVTISRAGNAGELVSPLLLPPTRRRRRRHIQGPGPVLNLPSAAAAPPVARAPEAAGGGSRSEDYSSSPHSAAAAARPLAAEEKQAQSLQPSSSRRSSHYPAAVQSQAAAERGASATAKSRAISILQKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKVDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 116 - protein, 1169 aa, Artificial Sequence
  Description of Artificial Sequence: Synthetic polypeptide
MWWRLWWLLLLLLLLWPMVWAAASESPVTISRAGNAGELVSPLLLPPTRRRRRRHIQGPGPVLNLPSAAAAPPVARAPEAAGGGSRSEDYSSSPHSAAAAARPLAAEEKQAQSLQPSSSRRSSHYPAAVQSQAAAERGASATAKSRAISILQKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKVDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 117 - protein, 1169 aa, Artificial Sequence
  Description of Artificial Sequence: Synthetic polypeptide
MKWVTFLLLLFVSGSAFSRGVFRRSESPVTIARAGNAGELLSPLLLPPTRRRRRRHVQGPGPVLSLPSAAAAPPLARAPEAAGGGSRCEDYPSSPHSAASAARPLAAEEKQAQSLQPSSSRRSSHYPAAVQGQAAAERGASATAKSRAISILQKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHSQITKVEAHKSEIAHRFKDLGEQHFKGLVLIAFSQYLQKCPYEEHIKLVQEVTDFAKTCVADENAENCDKSIHTLFGDKLCAIPKLRDNYGELADCCAKQEPERNECFLQHKDDNPNLPPFQRPEAEAMCTSFQENPTSFLGHYLHEVARRHPYFYAPELLYYAEKYNEVLTQCCTESDKAACLTPKLDAVKEKALVAAVRQRMKCSSMQRFGERAFKAWAVARMSQRFPNAEFAEITKLATDVTKINKECCHGDLLECADDRAELAKYMCENQATISSKLQACCDKPVLQKSQCLAEIEHDNIPADLPSIAADFVEDKEVCKNYAEAKDVFLGTFLYEYSRRHPDYSVSLLLRLAKKYEATLEKCCAEGDPPACYGTVLAEFQPLVEEPKNLVKTNCELYEKLGEYGFQNAVLVRYTQKAPQVSTPTLVEAARNLGRVGTKCCTLPEAQRLPCVEDYLSAILNRLCVLHEKTPVSEKVTKCCSGSLVERRPCFSALTVDETYVPKEFKAETFTFHSDICTLPDKEKQIKKQTALAELVKHKPKATEDQLKTVMGDFAQFVDKCCKAADKDNCFATEGPNLVARSKEALAHHHHHH

SEQ ID NO: 118 - protein, 1179 aa, Artificial Sequence
  Description of Artificial Sequence: Synthetic polypeptide
MKWVTFISLLFLFSSAYSRGVFRRYPYDVPDYASESPVTISRAGNAGELVSPLLLPPTRRRRRRHIQGPGPVLNLPSAAAAPPVARAPEAAGGGSRSEDYSSSPHSAAAAARPLAAEEKQAQSLQPSSSRRSSHYPAAVQSQAAAERGASATAKSRAISILQKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKVDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 119 - protein, 1164 aa, Artificial Sequence
  Description of Artificial Sequence: Synthetic polypeptide
MKWVTFISLLFLFSSAYSRGVFRRSESPVTISRAGNAGELVSPLLLPPTRRRRRRHIQGPGPVLNLPSAAAAPPVARAPEAAGGGSRSEDYSSSPHSAAAAARPLAAEEKQAQSLQPSSSRRSSHYPAAVQSQAAAERGASATAKSRAISILQKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKVDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 120 - protein, 1158 aa, Artificial Sequence
  Description of Artificial Sequence: Synthetic polypeptide
MKWVTFISLLFLFSSAYSRGVFRRISRAGNAGELVSPLLLPPTRRRRRRHIQGPGPVLNLPSAAAAPPVARAPEAAGGGSRSEDYSSSPHSAAAAARPLAAEEKQAQSLQPSSSRRSSHYPAAVQSQAAAERGASATAKSRAISILQKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKVDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 121 - protein, 970 aa, Artificial Sequence
  Description of Artificial Sequence: Synthetic polypeptide
MKWVTFISLLFLFSSAYSRGVFRRSESPVTISRAGNAGELVSPLLLPPTRRRRRRHIQGPGPVLNLPSAAAAPPVARAPEAAGGGSRSEDYSSSPHSAAAAARPLAAEEKQAQSLQPSSSRRSSHYPAAVQSQAAAERGASATAKSRAISILQKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKVDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQHHHHHH

SEQ ID NO: 122 - protein, 782 aa, Artificial Sequence
  Description of Artificial Sequence: Synthetic polypeptide
MKWVTFISLLFLFSSAYSRGVFRRSESPVTISRAGNAGELVSPLLLPPTRRRRRRHIQGPGPVLNLPSAAAAPPVARAPEAAGGGSRSEDYSSSPHSAAAAARPLAAEEKQAQSLQPSSSRRSSHYPAAVQSQAAAERGASATAKSRAISILQKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKVDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRHHHHHH

SEQ ID NO: 123 - protein, 1136 aa, Artificial Sequence
  Description of Artificial Sequence: Synthetic polypeptide
MKWVTFISLLFLFSSAYSRGVFRRSESPVTISRAGNAGELVSPLLLPPTRRRRRRHIQGPGPVLNLPSAAAAPPVARAPEAAGGGSRSEDYSSSPHSAAAAARPLAAEEKQAQSLQPSSSRRSSHYPAAVQSQAAAERGASATAKSRAISILQKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKVPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 124 - protein, 1108 aa, Artificial Sequence
  Description of Artificial Sequence: Synthetic polypeptide
MKWVTFISLLFLFSSAYSRGVFRRSESPVTISRAGNAGELVSPLLLPPTRRRRRRHIQGPGPVLNLPSAAAAPPVARAPEAAGGGSRSEDYSSSPHSAAAAARPLAAEEKQAQSLQPSSSRRSSHYPAAVQSQAAAERGASATAKSRAISILQKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKVDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 125 - protein, 1017 aa, Artificial Sequence
  Description of Artificial Sequence: Synthetic polypeptide
MKWVTFISLLFLFSSAYSRGVFRRTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKVDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 126 - protein, 1016 aa, Artificial Sequence
  Description of Artificial Sequence: Synthetic polypeptide
MKWVTFLLLLFVSGSAFSRGVFRREAHKSEIAHRFKDLGEQHFKGLVLIAFSQYLQKCPYEEHIKLVQEVTDFAKTCVADENAENCDKSIHTLFGDKLCAIPKLRDNYGELADCCAKQEPERNECFLQHKDDNPNLPPFQRPEAEAMCTSFQENPTSFLGHYLHEVARRHPYFYAPELLYYAEKYNEVLTQCCTESDKAACLTPKLDAVKEKALVAAVRQRMKCSSMQRFGERAFKAWAVARMSQRFPNAEFAEITKLATDVTKINKECCHGDLLECADDRAELAKYMCENQATISSKLQACCDKPVLQKSQCLAEIEHDNIPADLPSIAADFVEDKEVCKNYAEAKDVFLGTFLYEYSRRHPDYSVSLLLRLAKKYEATLEKCCAEGDPPACYGTVLAEFQPLVEEPKNLVKTNCELYEKLGEYGFQNAVLVRYTQKAPQVSTPTLVEAARNLGRVGTKCCTLPEAQRLPCVEDYLSAILNRLCVLHEKTPVSEKVTKCCSGSLVERRPCFSALTVDETYVPKEFKAETFTFHSDICTLPDKEKQIKKQTALAELVKHKPKATEDQLKTVMGDFAQFVDKCCKAADKDNCFATEGPNLVARSKEALATAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHSQITKVHHHHHH

SEQ ID NO: 127 - protein, 813 aa, Artificial Sequence
  Description of Artificial Sequence: Synthetic polypeptide
MKWVTFLLLLFVSGSAFSRGVFRREAHKSEIAHRFKDLGEQHFKGLVLIAFSQYLQKCPYEEHIKLVQEVTDFAKTCVADENAENCDKSIHTLFGDKLCAIPKLRDNYGELADCCAKQEPERNECFLQHKDDNPNLPPFQRPEAEAMCTSFQENPTSFLGHYLHEVARRHPYFYAPELLYYAEKYNEVLTQCCTESDKAACLTPKLDAVKEKALVAAVRQRMKCSSMQRFGERAFKAWAVARMSQRFPNAEFAEITKLATDVTKINKECCHGDLLECADDRAELAKYMCENQATISSKLQACCDKPVLQKSQCLAEIEHDNIPADLPSIAADFVEDKEVCKNYAEAKDVFLGTFLYEYSRRHPDYSVSLLLRLAKKYEATLEKCCAEGDPPACYGTVLAEFQPLVTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHSQITKVHHHHHH

SEQ ID NO: 128 - protein, 1016 aa, Artificial Sequence
  Description of Artificial Sequence: Synthetic polypeptide
MKWVTFLLLLFVSGSAFSRGVFRREAHKSEIAHRYNDLGEQHFKGLVLIAFSQYLQKCSYDEHAKLVQEVTDFAKTCVADESAANCDKSLHTLFGDKLCAIPNLRENYGELADCCTKQEPERNECFLQHKDDNPSLPPFERPEAEAMCTSFKENPTTFMGHYLHEVARRHPYFYAPELLYYAEQYNEILTQCCAEADKESCLTPKLDGVKEKALVSSVRQRMKCSSMQKFGERAFKAWAVARLSQTFPNADFAEITKLATDLTKVNKECCHGDLLECADDRAELAKYMCENQATISSKLQTCCDKPLLKKAHCLSEVEHDTMPADLPAIAADFVEDQEVCKNYAEAKDVFLGTFLYEYSRRHPDYSVSLLLRLAKKYEATLEKCCAEANPPACYGTVLAEFQPLVEEPKNLVKTNCDLYEKLGEYGFQNAILVRYTQKAPQVSTPTLVEAARNLGRVGTKCCTLPEDQRLPCVEDYLSAILNRVCLLHEKTPVSEHVTKCCSGSLVERRPCFSALTVDETYVPKEFKAETFTFHSDICTLPEKEKQIKKQTALAELVKHKPKATAEQLKTVMDDFAQFLDTCCKAADKDTCFSTEGPNLVTRCKDALATAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHSQITKVHHHHHH

SEQ ID NO: 129 - protein, 1178 aa, Artificial Sequence
  Description of Artificial Sequence: Synthetic polypeptide
MKWVTFISLLFLFSSAYSRGVFRRSESPVTISRAGNAGELVSPLLLPPTRRRRRRHIQGPGPVLNLPSAAAAPPVARAPEAAGGGSRSEDYSSSPHSAAAAARPLAAEEKQAQSLQPSSSRRSSHYPAAVQSQAAAERGASATAKSRAISILQKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKVGPAALKAADAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 130 - protein, 1175 aa, Artificial Sequence
  Description of Artificial Sequence: Synthetic polypeptide
MKWVTFISLLFLFSSAYSRGVFRRSESPVTISRAGNAGELVSPLLLPPTRRRRRRHIQGPGPVLNLPSAAAAPPVARAPEAAGGGSRSEDYSSSPHSAAAAARPLAAEEKQAQSLQPSSSRRSSHYPAAVQSQAAAERGASATAKSRAISILQKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKVGGAGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 131 - protein, 1174 aa, Artificial Sequence
  Description of Artificial Sequence: Synthetic polypeptide
MKWVTFISLLFLFSSAYSRGVFRRSESPVTISRAGNAGELVSPLLLPPTRRRRRRHIQGPGPVLNLPSAAAAPPVARAPEAAGGGSRSEDYSSSPHSAAAAARPLAAEEKQAQSLQPSSSRRSSHYPAAVQSQAAAERGASATAKSRAISILQKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKVGFVGDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 132 - protein, 1175 aa, Artificial Sequence
  Description of Artificial Sequence: Synthetic polypeptide
MKWVTFISLLFLFSSAYSRGVFRRSESPVTISRAGNAGELVSPLLLPPTRRRRRRHIQGPGPVLNLPSAAAAPPVARAPEAAGGGSRSEDYSSSPHSAAAAARPLAAEEKQAQSLQPSSSRRSSHYPAAVQSQAAAERGASATAKSRAISILQKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHTQITKVFGFVGDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 133 - protein, 1160 aa, Artificial Sequence
  Description of Artificial Sequence: Synthetic polypeptide
MKWVTFISLLFLFSSAYSRGVFRRSESPVTISRAGNAGELVSPLLLPPTRRRRRRHIQGPGPVLNLPSAAAAPPVARAPEAAGGGSRSEDYSSSPHSAAAAARPLAAEEKQAQSLQPSSSRRSSHYPAAVQSQAAAERGASATAKSRAISILQKKPRHQQLLPSLSSFFFSHRLPDMEEPQSDPSVEPPLSQETFSDLWKLLPENNVLSPLPSQAMDDLMLSPDDIEQWFTEDPGPDEAPRMPEAAPPVAPAPAAPTPAAPAPAPSWPLSSSVPSQKTYQGSYGFRLGFLHSGTAKSVTCTYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQIRGRERFEMFRELNEALELKDAQAGKEPGGSRAHSSHLKSKKGQSTSRHKKLMFKTEGPDSDDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 134 - protein, 152 aa, Artificial Sequence
  Description of Artificial Sequence: Synthetic polypeptide
SESPVTISRAGNAGELVSPLLLPPTRRRRRRHIQGPGPVLNLPDAAAAPPVARAPEAAGGGSRDEDYSSSPHSAAAAARPLAAEEKQAQSLQPDSDRRSSHYPAAVQDQAAAERGASADAKSRAISILQKKPRHQQLLPDLSDFFFDHRLPD

SEQ ID NO: 135 - DNA, 2274 bp, Artificial Sequence
  Description of Artificial Sequence: Synthetic polynucleotide
gaattcccgccgccaccatggtgaagcagatcgagagcaagaccgctttccaggaggctctggacgctgctggcgataagctggtggtggtggacttttctgccacatggtgcggcccctgtaagatgatcaagcctttctttcactccctgagcgagaagtactctaacgtgatcttcctggaggtggacgtggacgattgccaggatgtggcttccgagtgcgaggtgaagtgtatgccaaccttccagttctttaagaagggccagaaagtgggcgagttttccggcgccaacaaggagaagctggaggctacaatcaatgagctggtgcatcaccatcaccatcaccagatcttcgtgaagaccctgacaggcaagaccatcacactggaggtggagccctccgatacaatcgagaatgtgaaggccaagatccaggacaaggagggcatcccccctgatcagcagaggctgatctttgctggcaagcagctggaggacggacggaccctgagcgattacaacatccagaaggagtctacactgcatctggtgctgagactgcgcggcgagaatctgtatttccagggcagcgagagccctgtgaccatctccagggccggaaatgcaggagagctggtgtctcctctgctgctgccacctacacggagaaggcgccggagacacatccagggaccaggacctgtgctgaacctgccaagcgccgccgccgccccacccgtggccagagccccagaggcagcaggaggaggctccagatctgaggactatagctcctctccacacagcgccgccgccgccgcccggcccctggccgccgaggagaagcaggcccagtctctgcagcccagctcctctaggcgcagctcccactaccctgcagcagtgcagtcccaggctgccgccgagaggggagcctctgccaccgcaaagtctcgcgccatcagcatcctgcagaagaagccacgccaccagcagctgctgccctctctgtctagcttctttttcagccaccggctgcccgacatgaccgccatcatcaaggagatcgtgagcagaaataagcggcggtaccaggaggatggcttcgacctggatctgacatatatctaccccaacatcatcgccatgggatttcctgcagagcggctggagggcgtgtacagaaacaatatcgacgatgtggtgaggttcctggactccaagcacaagaaccactataagatctacaatctgtgcgccgagaggcactatgataccgccaagttcaactgtcgcgtggcccagtacccctttgaggaccacaatcctccacagctggagctgatcaagcctttctgcgaggacctggatcagtggctgtccgaggacgataatcacgtggcagcaatccactgcaaggcaggcaagggcaggacaggcgtgatgatctgtgcctatctgctgcaccgcggcaagttcctgaaggcccaggaggccctggacttttacggcgaggtgaggacccgcgataagaagggcgtgacaatcccaagccagcggcggtacgtgtactattactcctacctgctgaagaaccacctggactacaggccagtggccctgctgtttcacaagatgatgttcgagacaatccctatgttctccggcggcacatgcaacccacagtttgtggtgtgccagctgaaggtgaagatctattcctctaattctggcccaacccggagagaggataagttcatgtactttgagttcccacagccactgcccgtgtgcggcgacatcaaggtggagtttttccacaagcagaacaagatgctgaagaaggataagatgtttcacttctgggtgaatacctttttcatcccaggccccgaggagacatccgagaaggtggagaatggctctctgtgcgaccaggagatcgatagcatctgttccatcgagcgggccgacaacgataaggagtacctggtgctgaccctgacaaagaatgacctggataaggccaacaaggacaaggccaatagatacttcagccccaacttcaaggtgaagctgtacttcaccaagacagtggaggagccttccaatccagaggccagctcctctaccagcgtgacacctgacgtgtccgataacgagccagaccactatcggtactccgataccacagactctgatccagagaacgagccctttgacgaggatcagcacacccagatcacaaaggtgtgataagcttggatcc

SEQ ID NO: 136 - DNA, 3501 bp, Artificial Sequence
  Description of Artificial Sequence: Synthetic polynucleotide
gaattcccgccgccaccatgaaatgggtcacctttatcagcctgctgttcctgttcagcagcgcctacagcagaggcgtgttcagaagagatgcccacaagagcgaggtggcccacagattcaaggacctgggcgaagagaacttcaaggccctggtgctgatcgccttcgctcagtacctgcagcagtgcccctttgaggaccacgtgaagctggtcaacgaagtgaccgagttcgccaagacctgcgtggccgatgagagcgccgagaactgtgataagagcctgcacaccctgttcggcgacaagctgtgtacagtggccacactgagagaaacctacggcgagatggccgactgctgcgccaagcaagagcccgagagaaacgagtgcttcctgcagcacaaggacgacaaccccaacctgcctagactcgtgcggcctgaagtggacgtgatgtgcaccgccttccacgacaacgaggaaaccttcctgaagaagtacctgtacgagatcgccagacggcacccctacttttacgcccctgagctgctgttcttcgccaagcggtataaggccgccttcaccgagtgttgtcaggccgctgataaggctgcctgcctgctgcctaagctggacgagcttagagatgagggcaaagccagctccgccaagcagagactgaagtgtgccagcctgcagaagttcggcgagagagcctttaaggcctgggccgttgctagactgagccagagatttcccaaggccgagtttgccgaggtgtccaagctcgtgaccgacctgacaaaggtgcacaccgaatgctgccacggcgacctgctggaatgcgccgatgatagagccgacctggccaagtacatctgcgagaaccaggacagcatcagcagcaagctgaaagagtgctgcgagaagccactgctggaaaagagccactgtatcgccgaggtggaaaacgacgagatgcccgccgatctgccttctctggccgccgattttgtggaaagcaaggacgtgtgcaagaactacgccgaggccaaggatgtgttcctgggcatgtttctgtatgagtacgcccgcagacaccccgactactctgttgtgctgctgctgagactggccaaaacctacgagacaaccctggaaaagtgctgtgccgccgctgatcctcacgagtgttacgccaaggtgttcgacgagttcaagcctctggtggaagaaccccagaacctgatcaagcagaactgcgagctgttcgagcagctgggcgagtacaagttccagaacgccctgctcgtgcggtacaccaagaaggtgccccaggtttccacacctacactggttgaggtgtcccggaacctgggcaaagtgggcagcaagtgttgcaagcaccctgaggccaagagaatgccctgcgccgaggattacctgagcgtggtgctgaatcagctgtgcgtgctgcacgagaaaacccctgtgtccgacagagtgaccaagtgctgtaccgagagcctggtcaacagacggccttgctttagcgccctcgaggtggacgagacatacgtgcccaaagagttcaacgccgagacattcaccttccacgccgacatctgtaccctgagcgagaaagagcggcagatcaagaaacagactgccctggtggaactggtcaagcacaagcccaaggccaccaaagaacagctgaaggccgtgatggacgacttcgccgccttcgtggaaaaatgctgcaaggccgacgacaaagagacatgcttcgccgaagagggcaagaaactggtggccgcttctcaggctgctctcggacttatcagcagagctggaaatgccggcgagctggtgtctcctttgctgctgcctcctacccatatacaaggaccaggacctgtgctgaacctgccatctgctgctgcagctcctcctgtggctagagcacctgaagctgctggcggaggctctagaagcgaggactactctagcagccctcattctgctgccgctgccgctagacctctggctgccgaagaaaaacaggcccagagtctgcagcctagcagctccagaagaagcagccattatcctgccgccgtgcagtcacaggctgcagctgaaaggggagcctctgccacagccaagagcagagccatcagcatcctgcagaaaaagccccggcaccagcaactgctgccaagcctgagcagcttcttcttctctcaccggctgcctgacatgaccgccatcatcaaagaaatcgtgtctcggaacaagcggcgctaccaagaggacggcttcgacctggatctgacctacatctaccccaacatcattgccatgggcttccccgccgaaagactggaaggggtgtaccggaacaacatcgacgatgtcgtgcggttcctggactctaagcacaagaaccactacaagatctacaacctgtgcgccgagcggcactacgacaccgccaagttcaattgcagagtggcccagtatcctttcgaggatcacaaccctccacagctcgaactgattaagcccttctgcgaggacctggaccagtggctgagcgaggacgataatcacgtggccgccatccactgcaaagccggcaagggaagaaccggcgtgatgatctgtgcttacctgctgcaccggggcaagtttctgaaggcccaagaggctctggacttctacggcgaagtgcggaccagagacaagaaaggcgtgacaatccccagccagcggagatacgtgtactactacagctacctgctgaagaaccacctggactacagacccgtcgctctgctgtttcacaagatgatgttcgagactatccccatgttctccggcggcacctgtaatccccagttcgtcgtgtgtcagctcaaagtgaagatctactccagcaacagcggccccaccagacgcgaggataagttcatgtacttcgagttcccacagccactgcctgtgtgcggcgatatcaaggtggaatttttccataagcagaacaagatgctgaaaaaggacaagatgttccacttctgggtcaacaccttcttcatccccggacctgaagagacaagcgagaaggtcgagaacggctccctgtgcgaccaagagatcgacagcatctgctccatcgagcgggccgacaatgacaaagaatacctggtgctcaccctgaccaagaacgatctggacaaggccaacaaggataaggccaaccggtacttcagccccaacttcaaagtcaagctgtacttcaccaagaccgtcgaggaacccagcaatccagaggccagctctagcacctctgtgacccctgacgtgtccgataacgagcccgaccactacagatacagcgacaccaccgacagcgaccccgagaacgagccttttgatgaggaccagcacacccagatcaccaaggtgcaccaccaccatcaccactgataagctt

SEQ ID NO: 137 - DNA, 3537 bp, Artificial Sequence
  Description of Artificial Sequence: Synthetic polynucleotide
gaattcccgccgccaccatgaggagaaaccagctgcccacccctgccttcctgctgctgtttctgctgctgccaagggacgctagcgagagccctgtgaccatctccagggccggaaatgcaggagagctggtgtctcctctgctgctgccacctacacggagaaggcgccggagacacatccagggaccaggacctgtgctgaacctgccaagcgccgccgccgccccacccgtggccagagccccagaggcagcaggaggaggctccagatctgaggactatagctcctctccacacagcgccgccgccgccgcccggcccctggccgccgaggagaagcaggcccagtctctgcagcccagctcctctaggcgcagctcccactaccctgcagcagtgcagtcccaggctgccgccgagaggggagcctctgccaccgcaaagtctcgcgccatcagcatcctgcagaagaagccacgccaccagcagctgctgccctctctgtctagcttctttttcagccaccggctgcccgacatgaccgccatcatcaaggagatcgtgagcagaaataagcggcggtaccaggaggatggcttcgacctggatctgacatatatctaccccaacatcatcgccatgggatttcctgcagagcggctggagggcgtgtacagaaacaatatcgacgatgtggtgaggttcctggactccaagcacaagaaccactataagatctacaatctgtgcgccgagaggcactatgataccgccaagttcaactgtcgcgtggcccagtacccctttgaggaccacaatcctccacagctggagctgatcaagcctttctgcgaggacctggatcagtggctgtccgaggacgataatcacgtggcagcaatccactgcaaggcaggcaagggcaggacaggcgtgatgatctgtgcctatctgctgcaccgcggcaagttcctgaaggcccaggaggccctggacttttacggcgaggtgaggacccgcgataagaagggcgtgacaatcccaagccagcggcggtacgtgtactattactcctacctgctgaagaaccacctggactacaggccagtggccctgctgtttcacaagatgatgttcgagacaatccctatgttctccggcggcacatgcaacccacagtttgtggtgtgccagctgaaggtgaagatctattcctctaattctggcccaacccggagagaggataagttcatgtactttgagttcccacagccactgcccgtgtgcggcgacatcaaggtggagtttttccacaagcagaacaagatgctgaagaaggataagatgtttcacttctgggtgaatacctttttcatcccaggccccgaggagacatccgagaaggtggagaatggctctctgtgcgaccaggagatcgatagcatctgttccatcgagcgggccgacaacgataaggagtacctggtgctgaccctgacaaagaatgacctggataaggccaacaaggacaaggccaatagatacttcagccccaacttcaaggtgaagctgtacttcaccaagacagtggaggagccttccaatccagaggccagctcctctaccagcgtgacacctgacgtgtccgataacgagccagaccactatcggtactccgataccacagactctgatccagagaacgagccctttgacgaggatcagcacacccagatcacaaaggtggatgcccacaagagcgaggtggcccaccgctttaaggacctgggcgaggagaacttcaaggccctggtgctgatcgcctttgcccagtacctgcagcagtgcccattcgaggatcacgtgaagctggtgaatgaggtgaccgagtttgccaagacatgcgtggccgacgagagcgccgagaactgtgataagtccctgcacaccctgttcggcgacaagctgtgcaccgtggccacactgcgggagacatatggcgagatggccgattgctgtgccaaacaggagcctgagagaaatgagtgctttctgcagcacaaggacgataacccaaatctgcctaggctggtgcggcccgaggtggacgtgatgtgcaccgcctttcacgataacgaggagacattcctgaagaagtatctgtacgagatcgcccggagacacccctatttctacgcccctgagctgctgtttttcgccaagagatacaaggccgcctttaccgagtgctgtcaggcagcagacaaggcagcatgcctgctgccaaagctggacgagctgagggatgagggcaaggccagctccgccaagcagagactgaagtgtgccagcctgcagaagtttggagagagggccttcaaggcctgggcagtggcaaggctgagccagcggttcccaaaggcagagttcgcagaggtgtccaagctggtgaccgatctgacaaaggtgcacaccgagtgctgtcacggcgacctgctggagtgcgcagacgatagggcagatctggccaagtacatctgtgagaaccaggactctatctctagcaagctgaaggagtgctgtgagaagcccctgctggagaagagccactgcatcgccgaggtggagaatgacgagatgcctgccgatctgccatctctggccgccgacttcgtggagagcaaggacgtgtgcaagaactatgccgaggccaaggacgtgtttctgggcatgttcctgtatgagtacgccaggcgccaccccgattattccgtggtgctgctgctgcggctggccaagacctacgagacaaccctggagaagtgctgtgccgccgccgacccccacgagtgctacgcaaaggtgtttgacgagttcaagccactggtggaggagccccagaacctgatcaagcagaattgtgagctgttcgagcagctgggcgagtataagtttcagaatgccctgctggtgagatacacaaagaaggtgcctcaggtgtccaccccaacactggtggaggtgtctaggaacctgggcaaggtcggcagcaagtgctgtaagcacccagaggcaaagaggatgccttgcgccgaggactatctgtctgtggtgctgaaccagctgtgcgtgctgcacgagaagacccccgtgagcgatcgggtgaccaagtgctgtacagagtctctggtgaatagacggccctgcttcagcgccctggaggtggacgagacatacgtgccaaaggagtttaacgccgagacattcaccttccacgccgacatctgtaccctgtccgagaaggagagacagatcaagaagcagacagccctggtggagctggtgaagcacaagcctaaggccaccaaggagcagctgaaggccgtgatggacgattttgccgccttcgtggagaagtgctgtaaggccgacgataaggagacatgcttcgccgaggagggcaagaagctggtcgccgcttcacaggctgctctggggctgcatcaccaccaccaccactgataagcttggatcc

SEQ ID NO: 138 - DNA, 3528 bp, Artificial Sequence
  Description of Artificial Sequence: Synthetic polynucleotide
gaattcccgccgccaccatgctgtctctgagggtgacctgcctgatcctgagcgtggcctccaccgtgtggacaagcgagagccctgtgaccatctccagggccggaaatgcaggagagctggtgtctcctctgctgctgccacctacacggagaaggcgccggagacacatccagggaccaggacctgtgctgaacctgccaagcgccgccgccgccccacccgtggccagagccccagaggcagcaggaggaggctccagatctgaggactatagctcctctccacacagcgccgccgccgccgcccggcccctggccgccgaggagaagcaggcccagtctctgcagcccagctcctctaggcgcagctcccactaccctgcagcagtgcagtcccaggctgccgccgagaggggagcctctgccaccgcaaagtctcgcgccatcagcatcctgcagaagaagccacgccaccagcagctgctgccctctctgtctagcttctttttcagccaccggctgcccgacatgaccgccatcatcaaggagatcgtgagcagaaataagcggcggtaccaggaggatggcttcgacctggatctgacatatatctaccccaacatcatcgccatgggatttcctgcagagcggctggagggcgtgtacagaaacaatatcgacgatgtggtgaggttcctggactccaagcacaagaaccactataagatctacaatctgtgcgccgagaggcactatgataccgccaagttcaactgtcgcgtggcccagtacccctttgaggaccacaatcctccacagctggagctgatcaagcctttctgcgaggacctggatcagtggctgtccgaggacgataatcacgtggcagcaatccactgcaaggcaggcaagggcaggacaggcgtgatgatctgtgcctatctgctgcaccgcggcaagttcctgaaggcccaggaggccctggacttttacggcgaggtgaggacccgcgataagaagggcgtgacaatcccaagccagcggcggtacgtgtactattactcctacctgctgaagaaccacctggactacaggccagtggccctgctgtttcacaagatgatgttcgagacaatccctatgttctccggcggcacatgcaacccacagtttgtggtgtgccagctgaaggtgaagatctattcctctaattctggcccaacccggagagaggataagttcatgtactttgagttcccacagccactgcccgtgtgcggcgacatcaaggtggagtttttccacaagcagaacaagatgctgaagaaggataagatgtttcacttctgggtgaatacctttttcatcccaggccccgaggagacatccgagaaggtggagaatggctctctgtgcgaccaggagatcgatagcatctgttccatcgagcgggccgacaacgataaggagtacctggtgctgaccctgacaaagaatgacctggataaggccaacaaggacaaggccaatagatacttcagccccaacttcaaggtgaagctgtacttcaccaagacagtggaggagccttccaatccagaggccagctcctctaccagcgtgacacctgacgtgtccgataacgagccagaccactatcggtactccgataccacagactctgatccagagaacgagccctttgacgaggatcagcacacccagatcacaaaggtggatgcccacaagagcgaggtggcccaccgctttaaggacctgggcgaggagaacttcaaggccctggtgctgatcgcctttgcccagtacctgcagcagtgcccattcgaggatcacgtgaagctggtgaatgaggtgaccgagtttgccaagacatgcgtggccgacgagagcgccgagaactgtgataagtccctgcacaccctgttcggcgacaagctgtgcaccgtggccacactgcgggagacatatggcgagatggccgattgctgtgccaaacaggagcctgagagaaatgagtgctttctgcagcacaaggacgataacccaaatctgcctaggctggtgcggcccgaggtggacgtgatgtgcaccgcctttcacgataacgaggagacattcctgaagaagtatctgtacgagatcgcccggagacacccctatttctacgcccctgagctgctgtttttcgccaagagatacaaggccgcctttaccgagtgctgtcaggcagcagacaaggcagcatgcctgctgccaaagctggacgagctgagggatgagggcaaggccagctccgccaagcagagactgaagtgtgccagcctgcagaagtttggagagagggccttcaaggcctgggcagtggcaaggctgagccagcggttcccaaaggcagagttcgcagaggtgtccaagctggtgaccgatctgacaaaggtgcacaccgagtgctgtcacggcgacctgctggagtgcgcagacgatagggcagatctggccaagtacatctgtgagaaccaggactctatctctagcaagctgaaggagtgctgtgagaagcccctgctggagaagagccactgcatcgccgaggtggagaatgacgagatgcctgccgatctgccatctctggccgccgacttcgtggagagcaaggacgtgtgcaagaactatgccgaggccaaggacgtgtttctgggcatgttcctgtatgagtacgccaggcgccaccccgattattccgtggtgctgctgctgcggctggccaagacctacgagacaaccctggagaagtgctgtgccgccgccgacccccacgagtgctacgcaaaggtgtttgacgagttcaagccactggtggaggagccccagaacctgatcaagcagaattgtgagctgttcgagcagctgggcgagtataagtttcagaatgccctgctggtgagatacacaaagaaggtgcctcaggtgtccaccccaacactggtggaggtgtctaggaacctgggcaaggtcggcagcaagtgctgtaagcacccagaggcaaagaggatgccttgcgccgaggactatctgtctgtggtgctgaaccagctgtgcgtgctgcacgagaagacccccgtgagcgatcgggtgaccaagtgctgtacagagtctctggtgaatagacggccctgcttcagcgccctggaggtggacgagacatacgtgccaaaggagtttaacgccgagacattcaccttccacgccgacatctgtaccctgtccgagaaggagagacagatcaagaagcagacagccctggtggagctggtgaagcacaagcctaaggccaccaaggagcagctgaaggccgtgatggacgattttgccgccttcgtggagaagtgctgtaaggccgacgataaggagacatgcttcgccgaggagggcaagaagctggtcgccgcttcacaggctgctctggggctgcatcaccaccaccaccactgataagcttggatcc

SEQ ID NO: 139 - DNA, 3543 bp, Artificial Sequence
  Description of Artificial Sequence: Synthetic polynucleotide
gaattcccgccgccaccatgaccccaagcatctcctggggactgctgctgctggctggactgtgctgtctggtgccttctttcctggctagcgagagccctgtgaccatctccagggccggaaatgcaggagagctggtgtctcctctgctgctgccacctacacggagaaggcgccggagacacatccagggaccaggacctgtgctgaacctgccaagcgccgccgccgccccacccgtggccagagccccagaggcagcaggaggaggctccagatctgaggactatagctcctctccacacagcgccgccgccgccgcccggcccctggccgccgaggagaagcaggcccagtctctgcagcccagctcctctaggcgcagctcccactaccctgcagcagtgcagtcccaggctgccgccgagaggggagcctctgccaccgcaaagtctcgcgccatcagcatcctgcagaagaagccacgccaccagcagctgctgccctctctgtctagcttctttttcagccaccggctgcccgacatgaccgccatcatcaaggagatcgtgagcagaaataagcggcggtaccaggaggatggcttcgacctggatctgacatatatctaccccaacatcatcgccatgggatttcctgcagagcggctggagggcgtgtacagaaacaatatcgacgatgtggtgaggttcctggactccaagcacaagaaccactataagatctacaatctgtgcgccgagaggcactatgataccgccaagttcaactgtcgcgtggcccagtacccctttgaggaccacaatcctccacagctggagctgatcaagcctttctgcgaggacctggatcagtggctgtccgaggacgataatcacgtggcagcaatccactgcaaggcaggcaagggcaggacaggcgtgatgatctgtgcctatctgctgcaccgcggcaagttcctgaaggcccaggaggccctggacttttacggcgaggtgaggacccgcgataagaagggcgtgacaatcccaagccagcggcggtacgtgtactattactcctacctgctgaagaaccacctggactacaggccagtggccctgctgtttcacaagatgatgttcgagacaatccctatgttctccggcggcacatgcaacccacagtttgtggtgtgccagctgaaggtgaagatctattcctctaattctggcccaacccggagagaggataagttcatgtactttgagttcccacagccactgcccgtgtgcggcgacatcaaggtggagtttttccacaagcagaacaagatgctgaagaaggataagatgtttcacttctgggtgaatacctttttcatcccaggccccgaggagacatccgagaaggtggagaatggctctctgtgcgaccaggagatcgatagcatctgttccatcgagcgggccgacaacgataaggagtacctggtgctgaccctgacaaagaatgacctggataaggccaacaaggacaaggccaatagatacttcagccccaacttcaaggtgaagctgtacttcaccaagacagtggaggagccttccaatccagaggccagctcctctaccagcgtgacacctgacgtgtccgataacgagccagaccactatcggtactccgataccacagactctgatccagagaacgagccctttgacgaggatcagcacacccagatcacaaaggtggatgcccacaagagcgaggtggcccaccgctttaaggacctgggcgaggagaacttcaaggccctggtgctgatcgcctttgcccagtacctgcagcagtgcccattcgaggatcacgtgaagctggtgaatgaggtgaccgagtttgccaagacatgcgtggccgacgagagcgccgagaactgtgataagtccctgcacaccctgttcggcgacaagctgtgcaccgtggccacactgcgggagacatatggcgagatggccgattgctgtgccaaacaggagcctgagagaaatgagtgctttctgcagcacaaggacgataacccaaatctgcctaggctggtgcggcccgaggtggacgtgatgtgcaccgcctttcacgataacgaggagacattcctgaagaagtatctgtacgagatcgcccggagacacccctatttctacgcccctgagctgctgtttttcgccaagagatacaaggccgcctttaccgagtgctgtcaggcagcagacaaggcagcatgcctgctgccaaagctggacgagctgagggatgagggcaaggccagctccgccaagcagagactgaagtgtgccagcctgcagaagtttggagagagggccttcaaggcctgggcagtggcaaggctgagccagcggttcccaaaggcagagttcgcagaggtgtccaagctggtgaccgatctgacaaaggtgcacaccgagtgctgtcacggcgacctgctggagtgcgcagacgatagggcagatctggccaagtacatctgtgagaaccaggactctatctctagcaagctgaaggagtgctgtgagaagcccctgctggagaagagccactgcatcgccgaggtggagaatgacgagatgcctgccgatctgccatctctggccgccgacttcgtggagagcaaggacgtgtgcaagaactatgccgaggccaaggacgtgtttctgggcatgttcctgtatgagtacgccaggcgccaccccgattattccgtggtgctgctgctgcggctggccaagacctacgagacaaccctggagaagtgctgtgccgccgccgacccccacgagtgctacgcaaaggtgtttgacgagttcaagccactggtggaggagccccagaacctgatcaagcagaattgtgagctgttcgagcagctgggcgagtataagtttcagaatgccctgctggtgagatacacaaagaaggtgcctcaggtgtccaccccaacactggtggaggtgtctaggaacctgggcaaggtcggcagcaagtgctgtaagcacccagaggcaaagaggatgccttgcgccgaggactatctgtctgtggtgctgaaccagctgtgcgtgctgcacgagaagacccccgtgagcgatcgggtgaccaagtgctgtacagagtctctggtgaatagacggccctgcttcagcgccctggaggtggacgagacatacgtgccaaaggagtttaacgccgagacattcaccttccacgccgacatctgtaccctgtccgagaaggagagacagatcaagaagcagacagccctggtggagctggtgaagcacaagcctaaggccaccaaggagcagctgaaggccgtgatggacgattttgccgccttcgtggagaagtgctgtaaggccgacgataaggagacatgcttcgccgaggagggcaagaagctggtcgccgcttcacaggctgctctggggctgcatcaccaccaccaccactgataagcttggatcc

SEQ ID NO: 140 - DNA, 3531 bp, Artificial Sequence
  Description of Artificial Sequence: Synthetic polynucleotide
gaattcccgccgccaccatggagaccgacacactgctgctgtgggtgctgctgctgtgggtgccaggcagcaccggaagcgagagccctgtgaccatctccagggccggaaatgcaggagagctggtgtctcctctgctgctgccacctacacggagaaggcgccggagacacatccagggaccaggacctgtgctgaacctgccaagcgccgccgccgccccacccgtggccagagccccagaggcagcaggaggaggctccagatctgaggactatagctcctctccacacagcgccgccgccgccgcccggcccctggccgccgaggagaagcaggcccagtctctgcagcccagctcctctaggcgcagctcccactaccctgcagcagtgcagtcccaggctgccgccgagaggggagcctctgccaccgcaaagtctcgcgccatcagcatcctgcagaagaagccacgccaccagcagctgctgccctctctgtctagcttctttttcagccaccggctgcccgacatgaccgccatcatcaaggagatcgtgagcagaaataagcggcggtaccaggaggatggcttcgacctggatctgacatatatctaccccaacatcatcgccatgggatttcctgcagagcggctggagggcgtgtacagaaacaatatcgacgatgtggtgaggttcctggactccaagcacaagaaccactataagatctacaatctgtgcgccgagaggcactatgataccgccaagttcaactgtcgcgtggcccagtacccctttgaggaccacaatcctccacagctggagctgatcaagcctttctgcgaggacctggatcagtggctgtccgaggacgataatcacgtggcagcaatccactgcaaggcaggcaagggcaggacaggcgtgatgatctgtgcctatctgctgcaccgcggcaagttcctgaaggcccaggaggccctggacttttacggcgaggtgaggacccgcgataagaagggcgtgacaatcccaagccagcggcggtacgtgtactattactcctacctgctgaagaaccacctggactacaggccagtggccctgctgtttcacaagatgatgttcgagacaatccctatgttctccggcggcacatgcaacccacagtttgtggtgtgccagctgaaggtgaagatctattcctctaattctggcccaacccggagagaggataagttcatgtactttgagttcccacagccactgcccgtgtgcggcgacatcaaggtggagtttttccacaagcagaacaagatgctgaagaaggataagatgtttcacttctgggtgaatacctttttcatcccaggccccgaggagacatccgagaaggtggagaatggctctctgtgcgaccaggagatcgatagcatctgttccatcgagcgggccgacaacgataaggagtacctggtgctgaccctgacaaagaatgacctggataaggccaacaaggacaaggccaatagatacttcagccccaacttcaaggtgaagctgtacttcaccaagacagtggaggagccttccaatccagaggccagctcctctaccagcgtgacacctgacgtgtccgataacgagccagaccactatcggtactccgataccacagactctgatccagagaacgagccctttgacgaggatcagcacacccagatcacaaaggtggatgcccacaagagcgaggtggcccaccgctttaaggacctgggcgaggagaacttcaaggccctggtgctgatcgcctttgcccagtacctgcagcagtgcccattcgaggatcacgtgaagctggtgaatgaggtgaccgagtttgccaagacatgcgtggccgacgagagcgccgagaactgtgataagtccctgcacaccctgttcggcgacaagctgtgcaccgtggccacactgcgggagacatatggcgagatggccgattgctgtgccaaacaggagcctgagagaaatgagtgctttctgcagcacaaggacgataacccaaatctgcctaggctggtgcggcccgaggtggacgtgatgtgcaccgcctttcacgataacgaggagacattcctgaagaagtatctgtacgagatcgcccggagacacccctatttctacgcccctgagctgctgtttttcgccaagagatacaaggccgcctttaccgagtgctgtcaggcagcagacaaggcagcatgcctgctgccaaagctggacgagctgagggatgagggcaaggccagctccgccaagcagagactgaagtgtgccagcctgcagaagtttggagagagggccttcaaggcctgggcagtggcaaggctgagccagcggttcccaaaggcagagttcgcagaggtgtccaagctggtgaccgatctgacaaaggtgcacaccgagtgctgtcacggcgacctgctggagtgcgcagacgatagggcagatctggccaagtacatctgtgagaaccaggactctatctctagcaagctgaaggagtgctgtgagaagcccctgctggagaagagccactgcatcgccgaggtggagaatgacgagatgcctgccgatctgccatctctggccgccgacttcgtggagagcaaggacgtgtgcaagaactatgccgaggccaaggacgtgtttctgggcatgttcctgtatgagtacgccaggcgccaccccgattattccgtggtgctgctgctgcggctggccaagacctacgagacaaccctggagaagtgctgtgccgccgccgacccccacgagtgctacgcaaaggtgtttgacgagttcaagccactggtggaggagccccagaacctgatcaagcagaattgtgagctgttcgagcagctgggcgagtataagtttcagaatgccctgctggtgagatacacaaagaaggtgcctcaggtgtccaccccaacactggtggaggtgtctaggaacctgggcaaggtcggcagcaagtgctgtaagcacccagaggcaaagaggatgccttgcgccgaggactatctgtctgtggtgctgaaccagctgtgcgtgctgcacgagaagacccccgtgagcgatcgggtgaccaagtgctgtacagagtctctggtgaatagacggccctgcttcagcgccctggaggtggacgagacatacgtgccaaaggagtttaacgccgagacattcaccttccacgccgacatctgtaccctgtccgagaaggagagacagatcaagaagcagacagccctggtggagctggtgaagcacaagcctaaggccaccaaggagcagctgaaggccgtgatggacgattttgccgccttcgtggagaagtgctgtaaggccgacgataaggagacatgcttcgccgaggagggcaagaagctggtcgccgcttcacaggctgctctggggctgcatcaccaccaccaccactgataagcttggatcc

SEQ ID NO: 141 - DNA, 3531 bp, Artificial Sequence
  Description of Artificial Sequence: Synthetic polynucleotide
gaattcccgccgccaccatggtgctgcagacccaggtgttcatcagcctgctgctgtggatctccggcgcctacggaagcgagagccctgtgaccatctccagggccggaaatgcaggagagctggtgtctcctctgctgctgccacctacacggagaaggcgccggagacacatccagggaccaggacctgtgctgaacctgccaagcgccgccgccgccccacccgtggccagagccccagaggcagcaggaggaggctccagatctgaggactatagctcctctccacacagcgccgccgccgccgcccggcccctggccgccgaggagaagcaggcccagtctctgcagcccagctcctctaggcgcagctcccactaccctgcagcagtgcagtcccaggctgccgccgagaggggagcctctgccaccgcaaagtctcgcgccatcagcatcctgcagaagaagccacgccaccagcagctgctgccctctctgtctagcttctttttcagccaccggctgcccgacatgaccgccatcatcaaggagatcgtgagcagaaataagcggcggtaccaggaggatggcttcgacctggatctgacatatatctaccccaacatcatcgccatgggatttcctgcagagcggctggagggcgtgtacagaaacaatatcgacgatgtggtgaggttcctggactccaagcacaagaaccactataagatctacaatctgtgcgccgagaggcactatgataccgccaagttcaactgtcgcgtggcccagtacccctttgaggaccacaatcctccacagctggagctgatcaagcctttctgcgaggacctggatcagtggctgtccgaggacgataatcacgtggcagcaatccactgcaaggcaggcaagggcaggacaggcgtgatgatctgtgcctatctgctgcaccgcggcaagttcctgaaggcccaggaggccctggacttttacggcgaggtgaggacccgcgataagaagggcgtgacaatcccaagccagcggcggtacgtgtactattactcctacctgctgaagaaccacctggactacaggccagtggccctgctgtttcacaagatgatgttcgagacaatccctatgttctccggcggcacatgcaacccacagtttgtggtgtgccagctgaaggtgaagatctattcctctaattctggcccaacccggagagaggataagttcatgtactttgagttcccacagccactgcccgtgtgcggcgacatcaaggtggagtttttccacaagcagaacaagatgctgaagaaggataagatgtttcacttctgggtgaatacctttttcatcccaggccccgaggagacatccgagaaggtggagaatggctctctgtgcgaccaggagatcgatagcatctgttccatcgagcgggccgacaacgataaggagtacctggtgctgaccctgacaaagaatgacctggataaggccaacaaggacaaggccaatagatacttcagccccaacttcaaggtgaagctgtacttcaccaagacagtggaggagccttccaatccagaggccagctcctctaccagcgtgacacctgacgtgtccgataacgagccagaccactatcggtactccgataccacagactctgatccagagaacgagccctttgacgaggatcagcacacccagatcacaaaggtggatgcccacaagagcgaggtggcccaccgctttaaggacctgggcgaggagaacttcaaggccctggtgctgatcgcctttgcccagtacctgcagcagtgcccattcgaggatcacgtgaagctggtgaatgaggtgaccgagtttgccaagacatgcgtggccgacgagagcgccgagaactgtgataagtccctgcacaccctgttcggcgacaagctgtgcaccgtggccacactgcgggagacatatggcgagatggccgattgctgtgccaaacaggagcctgagagaaatgagtgctttctgcagcacaaggacgataacccaaatctgcctaggctggtgcggcccgaggtggacgtgatgtgcaccgcctttcacgataacgaggagacattcctgaagaagtatctgtacgagatcgcccggagacacccctatttctacgcccctgagctgctgtttttcgccaagagatacaaggccgcctttaccgagtgctgtcaggcagcagacaaggcagcatgcctgctgccaaagctggacgagctgagggatgagggcaaggccagctccgccaagcagagactgaagtgtgccagcctgcagaagtttggagagagggccttcaaggcctgggcagtggcaaggctgagccagcggttcccaaaggcagagttcgcagaggtgtccaagctggtgaccgatctgacaaaggtgcacaccgagtgctgtcacggcgacctgctggagtgcgcagacgatagggcagatctggccaagtacatctgtgagaaccaggactctatctctagcaagctgaaggagtgctgtgagaagcccctgctggagaagagccactgcatcgccgaggtggagaatgacgagatgcctgccgatctgccatctctggccgccgacttcgtggagagcaaggacgtgtgcaagaactatgccgaggccaaggacgtgtttctgggcatgttcctgtatgagtacgccaggcgccaccccgattattccgtggtgctgctgctgcggctggccaagacctacgagacaaccctggagaagtgctgtgccgccgccgacccccacgagtgctacgcaaaggtgtttgacgagttcaagccactggtggaggagccccagaacctgatcaagcagaattgtgagctgttcgagcagctgggcgagtataagtttcagaatgccctgctggtgagatacacaaagaaggtgcctcaggtgtccaccccaacactggtggaggtgtctaggaacctgggcaaggtcggcagcaagtgctgtaagcacccagaggcaaagaggatgccttgcgccgaggactatctgtctgtggtgctgaaccagctgtgcgtgctgcacgagaagacccccgtgagcgatcgggtgaccaagtgctgtacagagtctctggtgaatagacggccctgcttcagcgccctggaggtggacgagacatacgtgccaaaggagtttaacgccgagacattcaccttccacgccgacatctgtaccctgtccgagaaggagagacagatcaagaagcagacagccctggtggagctggtgaagcacaagcctaaggccaccaaggagcagctgaaggccgtgatggacgattttgccgccttcgtggagaagtgctgtaaggccgacgataaggagacatgcttcgccgaggagggcaagaagctggtcgccgcttcacaggctgctctggggctgcatcaccaccaccaccactgataagcttggatcc

SEQ ID NO: 142 - DNA, 3519 bp, Artificial Sequence
  Description of Artificial Sequence: Synthetic polynucleotide
gaattcccgccgccaccatgcccctgctgctgctgctgcctctgctgtgggccggcgctctggccagcgagagccctgtgaccatctccagggccggaaatgcaggagagctggtgtctcctctgctgctgccacctacacggagaaggcgccggagacacatccagggaccaggacctgtgctgaacctgccaagcgccgccgccgccccacccgtggccagagccccagaggcagcaggaggaggctccagatctgaggactatagctcctctccacacagcgccgccgccgccgcccggcccctggccgccgaggagaagcaggcccagtctctgcagcccagctcctctaggcgcagctcccactaccctgcagcagtgcagtcccaggctgccgccgagaggggagcctctgccaccgcaaagtctcgcgccatcagcatcctgcagaagaagccacgccaccagcagctgctgccctctctgtctagcttctttttcagccaccggctgcccgacatgaccgccatcatcaaggagatcgtgagcagaaataagcggcggtaccaggaggatggcttcgacctggatctgacatatatctaccccaacatcatcgccatgggatttcctgcagagcggctggagggcgtgtacagaaacaatatcgacgatgtggtgaggttcctggactccaagcacaagaaccactataagatctacaatctgtgcgccgagaggcactatgataccgccaagttcaactgtcgcgtggcccagtacccctttgaggaccacaatcctccacagctggagctgatcaagcctttctgcgaggacctggatcagtggctgtccgaggacgataatcacgtggcagcaatccactgcaaggcaggcaagggcaggacaggcgtgatgatctgtgcctatctgctgcaccgcggcaagttcctgaaggcccaggaggccctggacttttacggcgaggtgaggacccgcgataagaagggcgtgacaatcccaagccagcggcggtacgtgtactattactcctacctgctgaagaaccacctggactacaggccagtggccctgctgtttcacaagatgatgttcgagacaatccctatgttctccggcggcacatgcaacccacagtttgtggtgtgccagctgaaggtgaagatctattcctctaattctggcccaacccggagagaggataagttcatgtactttgagttcccacagccactgcccgtgtgcggcgacatcaaggtggagtttttccacaagcagaacaagatgctgaagaaggataagatgtttcacttctgggtgaatacctttttcatcccaggccccgaggagacatccgagaaggtggagaatggctctctgtgcgaccaggagatcgatagcatctgttccatcgagcgggccgacaacgataaggagtacctggtgctgaccctgacaaagaatgacctggataaggccaacaaggacaaggccaatagatacttcagccccaacttcaaggtgaagctgtacttcaccaagacagtggaggagccttccaatccagaggccagctcctctaccagcgtgacacctgacgtgtccgataacgagccagaccactatcggtactccgataccacagactctgatccagagaacgagccctttgacgaggatcagcacacccagatcacaaaggtggatgcccacaagagcgaggtggcccaccgctttaaggacctgggcgaggagaacttcaaggccctggtgctgatcgcctttgcccagtacctgcagcagtgcccattcgaggatcacgtgaagctggtgaatgaggtgaccgagtttgccaagacatgcgtggccgacgagagcgccgagaactgtgataagtccctgcacaccctgttcggcgacaagctgtgcaccgtggccacactgcgggagacatatggcgagatggccgattgctgtgccaaacaggagcctgagagaaatgagtgctttctgcagcacaaggacgataacccaaatctgcctaggctggtgcggcccgaggtggacgtgatgtgcaccgcctttcacgataacgaggagacattcctgaagaagtatctgtacgagatcgcccggagacacccctatttctacgcccctgagctgctgtttttcgccaagagatacaaggccgcctttaccgagtgctgtcaggcagcagacaaggcagcatgcctgctgccaaagctggacgagctgagggatgagggcaaggccagctccgccaagcagagactgaagtgtgccagcctgcagaagtttggagagagggccttcaaggcctgggcagtggcaaggctgagccagcggttcccaaaggcagagttcgcagaggtgtccaagctggtgaccgatctgacaaaggtgcacaccgagtgctgtcacggcgacctgctggagtgcgcagacgatagggcagatctggccaagtacatctgtgagaaccaggactctatctctagcaagctgaaggagtgctgtgagaagcccctgctggagaagagccactgcatcgccgaggtggagaatgacgagatgcctgccgatctgccatctctggccgccgacttcgtggagagcaaggacgtgtgcaagaactatgccgaggccaaggacgtgtttctgggcatgttcctgtatgagtacgccaggcgccaccccgattattccgtggtgctgctgctgcggctggccaagacctacgagacaaccctggagaagtgctgtgccgccgccgacccccacgagtgctacgcaaaggtgtttgacgagttcaagccactggtggaggagccccagaacctgatcaagcagaattgtgagctgttcgagcagctgggcgagtataagtttcagaatgccctgctggtgagatacacaaagaaggtgcctcaggtgtccaccccaacactggtggaggtgtctaggaacctgggcaaggtcggcagcaagtgctgtaagcacccagaggcaaagaggatgccttgcgccgaggactatctgtctgtggtgctgaaccagctgtgcgtgctgcacgagaagacccccgtgagcgatcgggtgaccaagtgctgtacagagtctctggtgaatagacggccctgcttcagcgccctggaggtggacgagacatacgtgccaaaggagtttaacgccgagacattcaccttccacgccgacatctgtaccctgtccgagaaggagagacagatcaagaagcagacagccctggtggagctggtgaagcacaagcctaaggccaccaaggagcagctgaaggccgtgatggacgattttgccgccttcgtggagaagtgctgtaaggccgacgataaggagacatgcttcgccgaggagggcaagaagctggtcgccgcttcacaggctgctctggggctgcatcaccaccaccaccactgataagcttggatcc

SEQ ID NO: 143 - DNA, 3534 bp, Artificial Sequence
  Description of Artificial Sequence: Synthetic polynucleotide
gaattcccgccgccaccatgtggtggaggctgtggtggctcctcctgctgctgctgctgctgtggcccatggtgtgggccagcgagagccctgtgaccatctccagggccggaaatgcaggagagctggtgtctcctctgctgctgccacctacacggagaaggcgccggagacacatccagggaccaggacctgtgctgaacctgccaagcgccgccgccgccccacccgtggccagagccccagaggcagcaggaggaggctccagatctgaggactatagctcctctccacacagcgccgccgccgccgcccggcccctggccgccgaggagaagcaggcccagtctctgcagcccagctcctctaggcgcagctcccactaccctgcagcagtgcagtcccaggctgccgccgagaggggagcctctgccaccgcaaagtctcgcgccatcagcatcctgcagaagaagccacgccaccagcagctgctgccctctctgtctagcttctttttcagccaccggctgcccgacatgaccgccatcatcaaggagatcgtgagcagaaataagcggcggtaccaggaggatggcttcgacctggatctgacatatatctaccccaacatcatcgccatgggatttcctgcagagcggctggagggcgtgtacagaaacaatatcgacgatgtggtgaggttcctggactccaagcacaagaaccactataagatctacaatctgtgcgccgagaggcactatgataccgccaagttcaactgtcgcgtggcccagtacccctttgaggaccacaatcctccacagctggagctgatcaagcctttctgcgaggacctggatcagtggctgtccgaggacgataatcacgtggcagcaatccactgcaaggcaggcaagggcaggacaggcgtgatgatctgtgcctatctgctgcaccgcggcaagttcctgaaggcccaggaggccctggacttttacggcgaggtgaggacccgcgataagaagggcgtgacaatcccaagccagcggcggtacgtgtactattactcctacctgctgaagaaccacctggactacaggccagtggccctgctgtttcacaagatgatgttcgagacaatccctatgttctccggcggcacatgcaacccacagtttgtggtgtgccagctgaaggtgaagatctattcctctaattctggcccaacccggagagaggataagttcatgtactttgagttcccacagccactgcccgtgtgcggcgacatcaaggtggagtttttccacaagcagaacaagatgctgaagaaggataagatgtttcacttctgggtgaatacctttttcatcccaggccccgaggagacatccgagaaggtggagaatggctctctgtgcgaccaggagatcgatagcatctgttccatcgagcgggccgacaacgataaggagtacctggtgctgaccctgacaaagaatgacctggataaggccaacaaggacaaggccaatagatacttcagccccaacttcaaggtgaagctgtacttcaccaagacagtggaggagccttccaatccagaggccagctcctctaccagcgtgacacctgacgtgtccgataacgagccagaccactatcggtactccgataccacagactctgatccagagaacgagccctttgacgaggatcagcacacccagatcacaaaggtggatgcccacaagagcgaggtggcccaccgctttaaggacctgggcgaggagaacttcaaggccctggtgctgatcgcctttgcccagtacctgcagcagtgcccattcgaggatcacgtgaagctggtgaatgaggtgaccgagtttgccaagacatgcgtggccgacgagagcgccgagaactgtgataagtccctgcacaccctgttcggcgacaagctgtgcaccgtggccacactgcgggagacatatggcgagatggccgattgctgtgccaaacaggagcctgagagaaatgagtgctttctgcagcacaaggacgataacccaaatctgcctaggctggtgcggcccgaggtggacgtgatgtgcaccgcctttcacgataacgaggagacattcctgaagaagtatctgtacgagatcgcccggagacacccctatttctacgcccctgagctgctgtttttcgccaagagatacaaggccgcctttaccgagtgctgtcaggcagcagacaaggcagcatgcctgctgccaaagctggacgagctgagggatgagggcaaggccagctccgccaagcagagactgaagtgtgccagcctgcagaagtttggagagagggccttcaaggcctgggcagtggcaaggctgagccagcggttcccaaaggcagagttcgcagaggtgtccaagctggtgaccgatctgacaaaggtgcacaccgagtgctgtcacggcgacctgctggagtgcgcagacgatagggcagatctggccaagtacatctgtgagaaccaggactctatctctagcaagctgaaggagtgctgtgagaagcccctgctggagaagagccactgcatcgccgaggtggagaatgacgagatgcctgccgatctgccatctctggccgccgacttcgtggagagcaaggacgtgtgcaagaactatgccgaggccaaggacgtgtttctgggcatgttcctgtatgagtacgccaggcgccaccccgattattccgtggtgctgctgctgcggctggccaagacctacgagacaaccctggagaagtgctgtgccgccgccgacccccacgagtgctacgcaaaggtgtttgacgagttcaagccactggtggaggagccccagaacctgatcaagcagaattgtgagctgttcgagcagctgggcgagtataagtttcagaatgccctgctggtgagatacacaaagaaggtgcctcaggtgtccaccccaacactggtggaggtgtctaggaacctgggcaaggtcggcagcaagtgctgtaagcacccagaggcaaagaggatgccttgcgccgaggactatctgtctgtggtgctgaaccagctgtgcgtgctgcacgagaagacccccgtgagcgatcgggtgaccaagtgctgtacagagtctctggtgaatagacggccctgcttcagcgccctggaggtggacgagacatacgtgccaaaggagtttaacgccgagacattcaccttccacgccgacatctgtaccctgtccgagaaggagagacagatcaagaagcagacagccctggtggagctggtgaagcacaagcctaaggccaccaaggagcagctgaaggccgtgatggacgattttgccgccttcgtggagaagtgctgtaaggccgacgataaggagacatgcttcgccgaggagggcaagaagctggtcgccgcttcacaggctgctctggggctgcatcaccaccaccaccactgataagcttggatcc

SEQ ID NO: 144 - DNA, 3540 bp, Artificial Sequence
  Description of Artificial Sequence: Synthetic polynucleotide
gaattcccgccgccaccatgtggtggaggctgtggtggctcctcctgctgctgctgctgctgtggcccatggtgtgggccgctgccagcgagagccctgtgaccatctccagggccggaaatgcaggagagctggtgtctcctctgctgctgccacctacacggagaaggcgccggagacacatccagggaccaggacctgtgctgaacctgccaagcgccgccgccgccccacccgtggccagagccccagaggcagcaggaggaggctccagatctgaggactatagctcctctccacacagcgccgccgccgccgcccggcccctggccgccgaggagaagcaggcccagtctctgcagcccagctcctctaggcgcagctcccactaccctgcagcagtgcagtcccaggctgccgccgagaggggagcctctgccaccgcaaagtctcgcgccatcagcatcctgcagaagaagccacgccaccagcagctgctgccctctctgtctagcttctttttcagccaccggctgcccgacatgaccgccatcatcaaggagatcgtgagcagaaataagcggcggtaccaggaggatggcttcgacctggatctgacatatatctaccccaacatcatcgccatgggatttcctgcagagcggctggagggcgtgtacagaaacaatatcgacgatgtggtgaggttcctggactccaagcacaagaaccactataagatctacaatctgtgcgccgagaggcactatgataccgccaagttcaactgtcgcgtggcccagtacccctttgaggaccacaatcctccacagctggagctgatcaagcctttctgcgaggacctggatcagtggctgtccgaggacgataatcacgtggcagcaatccactgcaaggcaggcaagggcaggacaggcgtgatgatctgtgcctatctgctgcaccgcggcaagttcctgaaggcccaggaggccctggacttttacggcgaggtgaggacccgcgataagaagggcgtgacaatcccaagccagcggcggtacgtgtactattactcctacctgctgaagaaccacctggactacaggccagtggccctgctgtttcacaagatgatgttcgagacaatccctatgttctccggcggcacatgcaacccacagtttgtggtgtgccagctgaaggtgaagatctattcctctaattctggcccaacccggagagaggataagttcatgtactttgagttcccacagccactgcccgtgtgcggcgacatcaaggtggagtttttccacaagcagaacaagatgctgaagaaggataagatgtttcacttctgggtgaatacctttttcatcccaggccccgaggagacatccgagaaggtggagaatggctctctgtgcgaccaggagatcgatagcatctgttccatcgagcgggccgacaacgataaggagtacctggtgctgaccctgacaaagaatgacctggataaggccaacaaggacaaggccaatagatacttcagccccaacttcaaggtgaagctgtacttcaccaagacagtggaggagccttccaatccagaggccagctcctctaccagcgtgacacctgacgtgtccgataacgagccagaccactatcggtactccgataccacagactctgatccagagaacgagccctttgacgaggatcagcacacccagatcacaaaggtggatgcccacaagagcgaggtggcccaccgctttaaggacctgggcgaggagaacttcaaggccctggtgctgatcgcctttgcccagtacctgcagcagtgcccattcgaggatcacgtgaagctggtgaatgaggtgaccgagtttgccaagacatgcgtggccgacgagagcgccgagaactgtgataagtccctgcacaccctgttcggcgacaagctgtgcaccgtggccacactgcgggagacatatggcgagatggccgattgctgtgccaaacaggagcctgagagaaatgagtgctttctgcagcacaaggacgataacccaaatctgcctaggctggtgcggcccgaggtggacgtgatgtgcaccgcctttcacgataacgaggagacattcctgaagaagtatctgtacgagatcgcccggagacacccctatttctacgcccctgagctgctgtttttcgccaagagatacaaggccgcctttaccgagtgctgtcaggcagcagacaaggcagcatgcctgctgccaaagctggacgagctgagggatgagggcaaggccagctccgccaagcagagactgaagtgtgccagcctgcagaagtttggagagagggccttcaaggcctgggcagtggcaaggctgagccagcggttcccaaaggcagagttcgcagaggtgtccaagctggtgaccgatctgacaaaggtgcacaccgagtgctgtcacggcgacctgctggagtgcgcagacgatagggcagatctggccaagtacatctgtgagaaccaggactctatctctagcaagctgaaggagtgctgtgagaagcccctgctggagaagagccactgcatcgccgaggtggagaatgacgagatgcctgccgatctgccatctctggccgccgacttcgtggagagcaaggacgtgtgcaagaactatgccgaggccaaggacgtgtttctgggcatgttcctgtatgagtacgccaggcgccaccccgattattccgtggtgctgctgctgcggctggccaagacctacgagacaaccctggagaagtgctgtgccgccgccgacccccacgagtgctacgcaaaggtgtttgacgagttcaagccactggtggaggagccccagaacctgatcaagcagaattgtgagctgttcgagcagctgggcgagtataagtttcagaatgccctgctggtgagatacacaaagaaggtgcctcaggtgtccaccccaacactggtggaggtgtctaggaacctgggcaaggtcggcagcaagtgctgtaagcacccagaggcaaagaggatgccttgcgccgaggactatctgtctgtggtgctgaaccagctgtgcgtgctgcacgagaagacccccgtgagcgatcgggtgaccaagtgctgtacagagtctctggtgaatagacggccctgcttcagcgccctggaggtggacgagacatacgtgccaaaggagtttaacgccgagacattcaccttccacgccgacatctgtaccctgtccgagaaggagagacagatcaagaagcagacagccctggtggagctggtgaagcacaagcctaaggccaccaaggagcagctgaaggccgtgatggacgattttgccgccttcgtggagaagtgctgtaaggccgacgataaggagacatgcttcgccgaggagggcaagaagctggtcgccgcttcacaggctgctctggggctgcatcaccaccaccaccactgataagcttggatcc

SEQ ID NO: 145 - DNA, 3537 bp, Artificial Sequence
  Description of Artificial Sequence: Synthetic polynucleotide
gaattcccgccgccaccatgaaatgggtcaccttcctcctcctgctgttcgtgtctggttccgcctttagccggggggtcttccgacggtcagagtcaccagtcaccatcgctagggctggaaacgctggagagctgctgtcccctctgctgctgccccctacaaggagacggcgcaggagacacgtgcagggacctggaccagtgctgtccctgccatctgccgctgctgctccaccactggctagggctcctgaggccgctggcggaggctctcgctgcgaggactacccaagctccccacacagcgccgcttccgccgctcggccactggctgctgaggagaagcaggctcagagcctgcagccttctagctcccggcgctctagccactacccagctgctgtgcagggacaggctgctgctgagaggggagcttccgccaccgctaagtccagagccatctctatcctgcagaagaagccaaggcaccagcagctgctgccttccctgtcctctttctttttctctcacaggctgcctgatatgaccgccatcatcaaggagatcgtgagcagaaacaagaggagataccaggaggacggcttcgacctggatctgacatacatctaccctaacatcatcgctatgggatttccagctgagcggctggagggcgtgtacaggaacaacatcgacgatgtggtgcggttcctggactccaagcacaagaaccactacaagatctacaacctgtgcgctgagaggcactacgacaccgccaagttcaactgtagagtggctcagtacccttttgaggatcacaaccctccacagctggagctgatcaagccattctgcgaggacctggatcagtggctgagcgaggacgataaccacgtggctgccatccactgcaaggccggaaagggccggacaggagtgatgatctgtgcttacctgctgcaccgcggcaagttcctgaaggctcaggaggccctggacttttacggagaggtgaggaccagagataagaagggcgtgacaatcccttcccagcggcgctacgtgtactactactcttacctgctgaagaaccacctggactaccgcccagtggccctgctgtttcacaagatgatgttcgagacaatcccaatgttctctggaggcacatgcaacccccagtttgtggtgtgccagctgaaggtgaagatctacagctccaacagcggaccaaccaggagagaggacaagttcatgtactttgagttcccacagcctctgcccgtgtgcggcgatatcaaggtggagtttttccacaagcagaacaagatgctgaagaaggacaagatgtttcacttctgggtcaacacctttttcatccccggacctgaggagacaagcgagaaggtggagaacggctccctgtgcgaccaggagatcgattctatctgtagcatcgagcgggccgacaacgataaggagtacctggtgctgaccctgacaaagaacgacctggataaggctaacaaggataaggccaaccgctacttttcccccaacttcaaggtgaagctgtacttcaccaagacagtggaggagccttctaacccagaggcctctagctccacctctgtgacaccagacgtgagcgataacgagcccgaccactacaggtacagcgataccacagactccgatcccgagaacgagccttttgacgaggatcagcacagccagatcaccaaggtggaggctcacaagtccgagatcgcccacaggttcaaggacctgggagagcagcacttcaagggcctggtgctgatcgccttttctcagtacctgcagaagtgcccctacgaggagcacatcaagctggtgcaggaggtgaccgatttcgctaagacatgcgtggctgacgagaacgccgagaactgtgataagagcatccacacactgtttggagacaagctgtgcgccatccccaagctgagggacaactacggcgagctggctgattgctgtgccaagcaggagcctgagagaaacgagtgcttcctgcagcacaaggacgataaccccaacctgccaccttttcagcggcctgaggctgaggctatgtgcacctcttttcaggagaaccccaccagcttcctgggacactacctgcacgaggtggctcggcgccacccttacttctacgctccagagctgctgtactacgctgagaagtacaacgaggtgctgacccagtgctgtacagagagcgacaaggctgcctgcctgacccccaagctggatgctgtgaaggagaaggccctggtggctgccgtgcggcagcgcatgaagtgttctagcatgcagaggtttggagagagagccttcaaggcctgggctgtggctaggatgtcccagaggttccctaacgctgagttcgccgagatcaccaagctggccaccgacgtgacaaagatcaacaaggagtgctgtcacggcgatctgctggagtgcgctgacgatagagctgagctggccaagtacatgtgcgagaaccaggccacaatctcctctaagctgcaggcttgctgtgacaagccagtgctgcagaagagccagtgcctggccgagatcgagcacgacaacatcccagctgatctgccctccatcgctgccgacttcgtggaggataaggaggtgtgcaagaactacgctgaggccaaggacgtgttcctgggcaccttcctgtacgagtacagcaggagacaccccgactatagcgtgtccctgctgctgaggctggctaagaagtacgaggccaccctggagaagtgctgtgctgagggcgaccccccagcttgctacggaacagtgctggctgagttccagccactggtggaggagcctaagaacctggtgaagaccaactgtgagctgtacgagaagctgggagagtacggctttcagaacgccgtgctggtgagatacacacagaaggctccacaggtgtccacccccacactggtggaggctgccaggaacctgggaagagtgggcaccaagtgctgtacactgcctgaggctcagcggctgccatgcgtggaggattacctgtctgctatcctgaaccgcctgtgcgtgctgcacgagaagacccccgtgagcgagaaggtgacaaagtgctgttctggaagcctggtggagcggcgcccatgcttctccgccctgaccgtggacgagacatacgtgcccaaggagtttaaggctgagacattcaccttccactctgacatctgtaccctgccagataaggagaagcagatcaagaagcagacagctctggccgagctggtgaagcacaagcccaaggccaccgaggaccagctgaagacagtgatgggcgactttgctcagttcgtggataagtgctgtaaggctgccgacaaggataactgtttcgccaccgaaggaccaaatctcgtcgctcgcagcaaagaggcactcgctcaccatcatcaccatcattaagcttggatcc

SEQ ID NO: 146 - DNA, 3570 bp, Artificial Sequence
  Description of Artificial Sequence: Synthetic polynucleotide
gaattcccgccgccaccatgaagtgggtgacctttattagcctgctgttcctgtttagttccgcatactcaagaggggtgtttagaagatacccctacgacgtgcccgactacgccagcgagagccctgtgaccatctccagggccggaaatgcaggagagctggtgtctcctctgctgctgccacctacacggagaaggcgccggagacacatccagggaccaggacctgtgctgaacctgccaagcgccgccgccgccccacccgtggccagagccccagaggcagcaggaggaggctccagatctgaggactatagctcctctccacacagcgccgccgccgccgcccggcccctggccgccgaggagaagcaggcccagtctctgcagcccagctcctctaggcgcagctcccactaccctgcagcagtgcagtcccaggctgccgccgagaggggagcctctgccaccgcaaagtctcgcgccatcagcatcctgcagaagaagccacgccaccagcagctgctgccctctctgtctagcttctttttcagccaccggctgcccgacatgaccgccatcatcaaggagatcgtgagcagaaataagcggcggtaccaggaggatggcttcgacctggatctgacatatatctaccccaacatcatcgccatgggatttcctgcagagcggctggagggcgtgtacagaaacaatatcgacgatgtggtgaggttcctggactccaagcacaagaaccactataagatctacaatctgtgcgccgagaggcactatgataccgccaagttcaactgtcgcgtggcccagtacccctttgaggaccacaatcctccacagctggagctgatcaagcctttctgcgaggacctggatcagtggctgtccgaggacgataatcacgtggcagcaatccactgcaaggcaggcaagggcaggacaggcgtgatgatctgtgcctatctgctgcaccgcggcaagttcctgaaggcccaggaggccctggacttttacggcgaggtgaggacccgcgataagaagggcgtgacaatcccaagccagcggcggtacgtgtactattactcctacctgctgaagaaccacctggactacaggccagtggccctgctgtttcacaagatgatgttcgagacaatccctatgttctccggcggcacatgcaacccacagtttgtggtgtgccagctgaaggtgaagatctattcctctaattctggcccaacccggagagaggataagttcatgtactttgagttcccacagccactgcccgtgtgcggcgacatcaaggtggagtttttccacaagcagaacaagatgctgaagaaggataagatgtttcacttctgggtgaatacctttttcatcccaggccccgaggagacatccgagaaggtggagaatggctctctgtgcgaccaggagatcgatagcatctgttccatcgagcgggccgacaacgataaggagtacctggtgctgaccctgacaaagaatgacctggataaggccaacaaggacaaggccaatagatacttcagccccaacttcaaggtgaagctgtacttcaccaagacagtggaggagccttccaatccagaggccagctcctctaccagcgtgacacctgacgtgtccgataacgagccagaccactatcggtactccgataccacagactctgatccagagaacgagccctttgacgaggatcagcacacccagatcacaaaggtggatgcccacaagagcgaggtggcccaccgctttaaggacctgggcgaggagaacttcaaggccctggtgctgatcgcctttgcccagtacctgcagcagtgcccattcgaggatcacgtgaagctggtgaatgaggtgaccgagtttgccaagacatgcgtggccgacgagagcgccgagaactgtgataagtccctgcacaccctgttcggcgacaagctgtgcaccgtggccacactgcgggagacatatggcgagatggccgattgctgtgccaaacaggagcctgagagaaatgagtgctttctgcagcacaaggacgataacccaaatctgcctaggctggtgcggcccgaggtggacgtgatgtgcaccgcctttcacgataacgaggagacattcctgaagaagtatctgtacgagatcgcccggagacacccctatttctacgcccctgagctgctgtttttcgccaagagatacaaggccgcctttaccgagtgctgtcaggcagcagacaaggcagcatgcctgctgccaaagctggacgagctgagggatgagggcaaggccagctccgccaagcagagactgaagtgtgccagcctgcagaagtttggagagagggccttcaaggcctgggcagtggcaaggctgagccagcggttcccaaaggcagagttcgcagaggtgtccaagctggtgaccgatctgacaaaggtgcacaccgagtgctgtcacggcgacctgctggagtgcgcagacgatagggcagatctggccaagtacatctgtgagaaccaggactctatctctagcaagctgaaggagtgctgtgagaagcccctgctggagaagagccactgcatcgccgaggtggagaatgacgagatgcctgccgatctgccatctctggccgccgacttcgtggagagcaaggacgtgtgcaagaactatgccgaggccaaggacgtgtttctgggcatgttcctgtatgagtacgccaggcgccaccccgattattccgtggtgctgctgctgcggctggccaagacctacgagacaaccctggagaagtgctgtgccgccgccgacccccacgagtgctacgcaaaggtgtttgacgagttcaagccactggtggaggagccccagaacctgatcaagcagaattgtgagctgttcgagcagctgggcgagtataagtttcagaatgccctgctggtgagatacacaaagaaggtgcctcaggtgtccaccccaacactggtggaggtgtctaggaacctgggcaaggtcggcagcaagtgctgtaagcacccagaggcaaagaggatgccttgcgccgaggactatctgtctgtggtgctgaaccagctgtgcgtgctgcacgagaagacccccgtgagcgatcgggtgaccaagtgctgtacagagtctctggtgaatagacggccctgcttcagcgccctggaggtggacgagacatacgtgccaaaggagtttaacgccgagacattcaccttccacgccgacatctgtaccctgtccgagaaggagagacagatcaagaagcagacagccctggtggagctggtgaagcacaagcctaaggccaccaaggagcagctgaaggccgtgatggacgattttgccgccttcgtggagaagtgctgtaaggccgacgataaggagacatgcttcgccgaggagggcaagaagctggtcgccgcttcacaggctgctctggggctgcatcaccaccaccaccactgataagcttggatcc

SEQ ID NO: 147 - DNA, 3525 bp, Artificial Sequence
  Description of Artificial Sequence: Synthetic polynucleotide
gaattcccgccgccaccatgaagtgggtgacctttattagcctgctgttcctgtttagttccgcatactcaagaggggtgtttagaagaagcgagagccctgtgaccatctccagggccggaaatgcaggagagctggtgtctcctctgctgctgccacctacacggagaaggcgccggagacacatccagggaccaggacctgtgctgaacctgccaagcgccgccgccgccccacccgtggccagagccccagaggcagcaggaggaggctccagatctgaggactatagctcctctccacacagcgccgccgccgccgcccggcccctggccgccgaggagaagcaggcccagtctctgcagcccagctcctctaggcgcagctcccactaccctgcagcagtgcagtcccaggctgccgccgagaggggagcctctgccaccgcaaagtctcgcgccatcagcatcctgcagaagaagccacgccaccagcagctgctgccctctctgtctagcttctttttcagccaccggctgcccgacatgaccgccatcatcaaggagatcgtgagcagaaataagcggcggtaccaggaggatggcttcgacctggatctgacatatatctaccccaacatcatcgccatgggatttcctgcagagcggctggagggcgtgtacagaaacaatatcgacgatgtggtgaggttcctggactccaagcacaagaaccactataagatctacaatctgtgcgccgagaggcactatgataccgccaagttcaactgtcgcgtggcccagtacccctttgaggaccacaatcctccacagctggagctgatcaagcctttctgcgaggacctggatcagtggctgtccgaggacgataatcacgtggcagcaatccactgcaaggcaggcaagggcaggacaggcgtgatgatctgtgcctatctgctgcaccgcggcaagttcctgaaggcccaggaggccctggacttttacggcgaggtgaggacccgcgataagaagggcgtgacaatcccaagccagcggcggtacgtgtactattactcctacctgctgaagaaccacctggactacaggccagtggccctgctgtttcacaagatgatgttcgagacaatccctatgttctccggcggcacatgcaacccacagtttgtggtgtgccagctgaaggtgaagatctattcctctaattctggcccaacccggagagaggataagttcatgtactttgagttcccacagccactgcccgtgtgcggcgacatcaaggtggagtttttccacaagcagaacaagatgctgaagaaggataagatgtttcacttctgggtgaatacctttttcatcccaggccccgaggagacatccgagaaggtggagaatggctctctgtgcgaccaggagatcgatagcatctgttccatcgagcgggccgacaacgataaggagtacctggtgctgaccctgacaaagaatgacctggataaggccaacaaggacaaggccaatagatacttcagccccaacttcaaggtgaagctgtacttcaccaagacagtggaggagccttccaatccagaggccagctcctctaccagcgtgacacctgacgtgtccgataacgagccagaccactatcggtactccgataccacagactctgatccagagaacgagccctttgacgaggatcagcacacccagatcacaaaggtggatgcccacaagagcgaggtggcccaccgctttaaggacctgggcgaggagaacttcaaggccctggtgctgatcgcctttgcccagtacctgcagcagagcccattcgaggatcacgtgaagctggtgaatgaggtgaccgagtttgccaagacatgcgtggccgacgagagcgccgagaactgtgataagtccctgcacaccctgttcggcgacaagctgtgcaccgtggccacactgcgggagacatatggcgagatggccgattgctgtgccaaacaggagcctgagagaaatgagtgctttctgcagcacaaggacgataacccaaatctgcctaggctggtgcggcccgaggtggacgtgatgtgcaccgcctttcacgataacgaggagacattcctgaagaagtatctgtacgagatcgcccggagacacccctatttctacgcccctgagctgctgtttttcgccaagagatacaaggccgcctttaccgagtgctgtcaggcagcagacaaggcagcatgcctgctgccaaagctggacgagctgagggatgagggcaaggccagctccgccaagcagagactgaagtgtgccagcctgcagaagtttggagagagggccttcaaggcctgggcagtggcaaggctgagccagcggttcccaaaggcagagttcgcagaggtgtccaagctggtgaccgatctgacaaaggtgcacaccgagtgctgtcacggcgacctgctggagtgcgcagacgatagggcagatctggccaagtacatctgtgagaaccaggactctatctctagcaagctgaaggagtgctgtgagaagcccctgctggagaagagccactgcatcgccgaggtggagaatgacgagatgcctgccgatctgccatctctggccgccgacttcgtggagagcaaggacgtgtgcaagaactatgccgaggccaaggacgtgtttctgggcatgttcctgtatgagtacgccaggcgccaccccgattattccgtggtgctgctgctgcggctggccaagacctacgagacaaccctggagaagtgctgtgccgccgccgacccccacgagtgctacgcaaaggtgtttgacgagttcaagccactggtggaggagccccagaacctgatcaagcagaattgtgagctgttcgagcagctgggcgagtataagtttcagaatgccctgctggtgagatacacaaagaaggtgcctcaggtgtccaccccaacactggtggaggtgtctaggaacctgggcaaggtcggcagcaagtgctgtaagcacccagaggcaaagaggatgccttgcgccgaggactatctgtctgtggtgctgaaccagctgtgcgtgctgcacgagaagacccccgtgagcgatcgggtgaccaagtgctgtacagagtctctggtgaatagacggccctgcttcagcgccctggaggtggacgagacatacgtgccaaaggagtttaacgccgagacattcaccttccacgccgacatctgtaccctgtccgagaaggagagacagatcaagaagcagacagccctggtggagctggtgaagcacaagcctaaggccaccaaggagcagctgaaggccgtgatggacgattttgccgccttcgtggagaagtgctgtaaggccgacgataaggagacatgcttcgccgaggagggcaagaagctggtcgccgcttcacaggctgctctggggctgtgataagcttggatcc

SEQ ID NO: 148 - DNA, 3507 bp, Artificial Sequence
  Description of Artificial Sequence: Synthetic polynucleotide
gaattcccgccgccaccatgaagtgggtgacctttattagcctgctgttcctgtttagttccgcatactcaagaggggtgtttagaagaatctccagggccggaaatgcaggagagctggtgtctcctctgctgctgccacctacacggagaaggcgccggagacacatccagggaccaggacctgtgctgaacctgccaagcgccgccgccgccccacccgtggccagagccccagaggcagcaggaggaggctccagatctgaggactatagctcctctccacacagcgccgccgccgccgcccggcccctggccgccgaggagaagcaggcccagtctctgcagcccagctcctctaggcgcagctcccactaccctgcagcagtgcagtcccaggctgccgccgagaggggagcctctgccaccgcaaagtctcgcgccatcagcatcctgcagaagaagccacgccaccagcagctgctgccctctctgtctagcttctttttcagccaccggctgcccgacatgaccgccatcatcaaggagatcgtgagcagaaataagcggcggtaccaggaggatggcttcgacctggatctgacatatatctaccccaacatcatcgccatgggatttcctgcagagcggctggagggcgtgtacagaaacaatatcgacgatgtggtgaggttcctggactccaagcacaagaaccactataagatctacaatctgtgcgccgagaggcactatgataccgccaagttcaactgtcgcgtggcccagtacccctttgaggaccacaatcctccacagctggagctgatcaagcctttctgcgaggacctggatcagtggctgtccgaggacgataatcacgtggcagcaatccactgcaaggcaggcaagggcaggacaggcgtgatgatctgtgcctatctgctgcaccgcggcaagttcctgaaggcccaggaggccctggacttttacggcgaggtgaggacccgcgataagaagggcgtgacaatcccaagccagcggcggtacgtgtactattactcctacctgctgaagaaccacctggactacaggccagtggccctgctgtttcacaagatgatgttcgagacaatccctatgttctccggcggcacatgcaacccacagtttgtggtgtgccagctgaaggtgaagatctattcctctaattctggcccaacccggagagaggataagttcatgtactttgagttcccacagccactgcccgtgtgcggcgacatcaaggtggagtttttccacaagcagaacaagatgctgaagaaggataagatgtttcacttctgggtgaatacctttttcatcccaggccccgaggagacatccgagaaggtggagaatggctctctgtgcgaccaggagatcgatagcatctgttccatcgagcgggccgacaacgataaggagtacctggtgctgaccctgacaaagaatgacctggataaggccaacaaggacaaggccaatagatacttcagccccaacttcaaggtgaagctgtacttcaccaagacagtggaggagccttccaatccagaggccagctcctctaccagcgtgacacctgacgtgtccgataacgagccagaccactatcggtactccgataccacagactctgatccagagaacgagccctttgacgaggatcagcacacccagatcacaaaggtggatgcccacaagagcgaggtggcccaccgctttaaggacctgggcgaggagaacttcaaggccctggtgctgatcgcctttgcccagtacctgcagcagagcccattcgaggatcacgtgaagctggtgaatgaggtgaccgagtttgccaagacatgcgtggccgacgagagcgccgagaactgtgataagtccctgcacaccctgttcggcgacaagctgtgcaccgtggccacactgcgggagacatatggcgagatggccgattgctgtgccaaacaggagcctgagagaaatgagtgctttctgcagcacaaggacgataacccaaatctgcctaggctggtgcggcccgaggtggacgtgatgtgcaccgcctttcacgataacgaggagacattcctgaagaagtatctgtacgagatcgcccggagacacccctatttctacgcccctgagctgctgtttttcgccaagagatacaaggccgcctttaccgagtgctgtcaggcagcagacaaggcagcatgcctgctgccaaagctggacgagctgagggatgagggcaaggccagctccgccaagcagagactgaagtgtgccagcctgcagaagtttggagagagggccttcaaggcctgggcagtggcaaggctgagccagcggttcccaaaggcagagttcgcagaggtgtccaagctggtgaccgatctgacaaaggtgcacaccgagtgctgtcacggcgacctgctggagtgcgcagacgatagggcagatctggccaagtacatctgtgagaaccaggactctatctctagcaagctgaaggagtgctgtgagaagcccctgctggagaagagccactgcatcgccgaggtggagaatgacgagatgcctgccgatctgccatctctggccgccgacttcgtggagagcaaggacgtgtgcaagaactatgccgaggccaaggacgtgtttctgggcatgttcctgtatgagtacgccaggcgccaccccgattattccgtggtgctgctgctgcggctggccaagacctacgagacaaccctggagaagtgctgtgccgccgccgacccccacgagtgctacgcaaaggtgtttgacgagttcaagccactggtggaggagccccagaacctgatcaagcagaattgtgagctgttcgagcagctgggcgagtataagtttcagaatgccctgctggtgagatacacaaagaaggtgcctcaggtgtccaccccaacactggtggaggtgtctaggaacctgggcaaggtcggcagcaagtgctgtaagcacccagaggcaaagaggatgccttgcgccgaggactatctgtctgtggtgctgaaccagctgtgcgtgctgcacgagaagacccccgtgagcgatcgggtgaccaagtgctgtacagagtctctggtgaatagacggccctgcttcagcgccctggaggtggacgagacatacgtgccaaaggagtttaacgccgagacattcaccttccacgccgacatctgtaccctgtccgagaaggagagacagatcaagaagcagacagccctggtggagctggtgaagcacaagcctaaggccaccaaggagcagctgaaggccgtgatggacgattttgccgccttcgtggagaagtgctgtaaggccgacgataaggagacatgcttcgccgaggagggcaagaagctggtcgccgcttcacaggctgctctggggctgtgataagcttggatcc

SEQ ID NO: 149 - DNA, 2943 bp, Artificial Sequence
  Description of Artificial Sequence: Synthetic polynucleotide
gaattcccgccgccaccatgaagtgggtgacctttattagcctgctgttcctgtttagttccgcatactcaagaggggtgtttagaagaagcgagagccctgtgaccatctccagggccggaaatgcaggagagctggtgtctcctctgctgctgccacctacacggagaaggcgccggagacacatccagggaccaggacctgtgctgaacctgccaagcgccgccgccgccccacccgtggccagagccccagaggcagcaggaggaggctccagatctgaggactatagctcctctccacacagcgccgccgccgccgcccggcccctggccgccgaggagaagcaggcccagtctctgcagcccagctcctctaggcgcagctcccactaccctgcagcagtgcagtcccaggctgccgccgagaggggagcctctgccaccgcaaagtctcgcgccatcagcatcctgcagaagaagccacgccaccagcagctgctgccctctctgtctagcttctttttcagccaccggctgcccgacatgaccgccatcatcaaggagatcgtgagcagaaataagcggcggtaccaggaggatggcttcgacctggatctgacatatatctaccccaacatcatcgccatgggatttcctgcagagcggctggagggcgtgtacagaaacaatatcgacgatgtggtgaggttcctggactccaagcacaagaaccactataagatctacaatctgtgcgccgagaggcactatgataccgccaagttcaactgtcgcgtggcccagtacccctttgaggaccacaatcctccacagctggagctgatcaagcctttctgcgaggacctggatcagtggctgtccgaggacgataatcacgtggcagcaatccactgcaaggcaggcaagggcaggacaggcgtgatgatctgtgcctatctgctgcaccgcggcaagttcctgaaggcccaggaggccctggacttttacggcgaggtgaggacccgcgataagaagggcgtgacaatcccaagccagcggcggtacgtgtactattactcctacctgctgaagaaccacctggactacaggccagtggccctgctgtttcacaagatgatgttcgagacaatccctatgttctccggcggcacatgcaacccacagtttgtggtgtgccagctgaaggtgaagatctattcctctaattctggcccaacccggagagaggataagttcatgtactttgagttcccacagccactgcccgtgtgcggcgacatcaaggtggagtttttccacaagcagaacaagatgctgaagaaggataagatgtttcacttctgggtgaatacctttttcatcccaggccccgaggagacatccgagaaggtggagaatggctctctgtgcgaccaggagatcgatagcatctgttccatcgagcgggccgacaacgataaggagtacctggtgctgaccctgacaaagaatgacctggataaggccaacaaggacaaggccaatagatacttcagccccaacttcaaggtgaagctgtacttcaccaagacagtggaggagccttccaatccagaggccagctcctctaccagcgtgacacctgacgtgtccgataacgagccagaccactatcggtactccgataccacagactctgatccagagaacgagccctttgacgaggatcagcacacccagatcacaaaggtggatgcccacaagagcgaggtggcccaccgctttaaggacctgggcgaggagaacttcaaggccctggtgctgatcgcctttgcccagtacctgcagcagtgcccattcgaggatcacgtgaagctggtgaatgaggtgaccgagtttgccaagacatgcgtggccgacgagagcgccgagaactgtgataagtccctgcacaccctgttcggcgacaagctgtgcaccgtggccacactgcgggagacatatggcgagatggccgattgctgtgccaaacaggagcctgagagaaatgagtgctttctgcagcacaaggacgataacccaaatctgcctaggctggtgcggcccgaggtggacgtgatgtgcaccgcctttcacgataacgaggagacattcctgaagaagtatctgtacgagatcgcccggagacacccctatttctacgcccctgagctgctgtttttcgccaagagatacaaggccgcctttaccgagtgctgtcaggcagcagacaaggcagcatgcctgctgccaaagctggacgagctgagggatgagggcaaggccagctccgccaagcagagactgaagtgtgccagcctgcagaagtttggagagagggccttcaaggcctgggcagtggcaaggctgagccagcggttcccaaaggcagagttcgcagaggtgtccaagctggtgaccgatctgacaaaggtgcacaccgagtgctgtcacggcgacctgctggagtgcgcagacgatagggcagatctggccaagtacatctgtgagaaccaggactctatctctagcaagctgaaggagtgctgtgagaagcccctgctggagaagagccactgcatcgccgaggtggagaatgacgagatgcctgccgatctgccatctctggccgccgacttcgtggagagcaaggacgtgtgcaagaactatgccgaggccaaggacgtgtttctgggcatgttcctgtatgagtacgccaggcgccaccccgattattccgtggtgctgctgctgcggctggccaagacctacgagacaaccctggagaagtgctgtgccgccgccgacccccacgagtgctacgcaaaggtgtttgacgagttcaagccactggtggaggagccccagcatcaccaccaccaccactgataagcttggatcc

SEQ ID NO: 150 - DNA, 2379 bp, Artificial Sequence
  Description of Artificial Sequence: Synthetic polynucleotide
gaattcccgccgccaccatgaagtgggtgacctttattagcctgctgttcctgtttagttccgcatactcaagaggggtgtttagaagaagcgagagccctgtgaccatctccagggccggaaatgcaggagagctggtgtctcctctgctgctgccacctacacggagaaggcgccggagacacatccagggaccaggacctgtgctgaacctgccaagcgccgccgccgccccacccgtggccagagccccagaggcagcaggaggaggctccagatctgaggactatagctcctctccacacagcgccgccgccgccgcccggcccctggccgccgaggagaagcaggcccagtctctgcagcccagctcctctaggcgcagctcccactaccctgcagcagtgcagtcccaggctgccgccgagaggggagcctctgccaccgcaaagtctcgcgccatcagcatcctgcagaagaagccacgccaccagcagctgctgccctctctgtctagcttctttttcagccaccggctgcccgacatgaccgccatcatcaaggagatcgtgagcagaaataagcggcggtaccaggaggatggcttcgacctggatctgacatatatctaccccaacatcatcgccatgggatttcctgcagagcggctggagggcgtgtacagaaacaatatcgacgatgtggtgaggttcctggactccaagcacaagaaccactataagatctacaatctgtgcgccgagaggcactatgataccgccaagttcaactgtcgcgtggcccagtacccctttgaggaccacaatcctccacagctggagctgatcaagcctttctgcgaggacctggatcagtggctgtccgaggacgataatcacgtggcagcaatccactgcaaggcaggcaagggcaggacaggcgtgatgatctgtgcctatctgctgcaccgcggcaagttcctgaaggcccaggaggccctggacttttacggcgaggtgaggacccgcgataagaagggcgtgacaatcccaagccagcggcggtacgtgtactattactcctacctgctgaagaaccacctggactacaggccagtggccctgctgtttcacaagatgatgttcgagacaatccctatgttctccggcggcacatgcaacccacagtttgtggtgtgccagctgaaggtgaagatctattcctctaattctggcccaacccggagagaggataagttcatgtactttgagttcccacagccactgcccgtgtgcggcgacatcaaggtggagtttttccacaagcagaacaagatgctgaagaaggataagatgtttcacttctgggtgaatacctttttcatcccaggccccgaggagacatccgagaaggtggagaatggctctctgtgcgaccaggagatcgatagcatctgttccatcgagcgggccgacaacgataaggagtacctggtgctgaccctgacaaagaatgacctggataaggccaacaaggacaaggccaatagatacttcagccccaacttcaaggtgaagctgtacttcaccaagacagtggaggagccttccaatccagaggccagctcctctaccagcgtgacacctgacgtgtccgataacgagccagaccactatcggtactccgataccacagactctgatccagagaacgagccctttgacgaggatcagcacacccagatcacaaaggtggatgcccacaagagcgaggtggcccaccgctttaaggacctgggcgaggagaacttcaaggccctggtgctgatcgcctttgcccagtacctgcagcagtgcccattcgaggatcacgtgaagctggtgaatgaggtgaccgagtttgccaagacatgcgtggccgacgagagcgccgagaactgtgataagtccctgcacaccctgttcggcgacaagctgtgcaccgtggccacactgcgggagacatatggcgagatggccgattgctgtgccaaacaggagcctgagagaaatgagtgctttctgcagcacaaggacgataacccaaatctgcctaggctggtgcggcccgaggtggacgtgatgtgcaccgcctttcacgataacgaggagacattcctgaagaagtatctgtacgagatcgcccggagacacccctatttctacgcccctgagctgctgtttttcgccaagagatacaaggccgcctttaccgagtgctgtcaggcagcagacaaggcagcatgcctgctgccaaagctggacgagctgagggatgagggcaaggccagctccgccaagcagagacatcaccaccaccaccactgataagcttggatcc

SEQ ID NO: 151 - DNA, 3441 bp, Artificial Sequence
  Description of Artificial Sequence: Synthetic polynucleotide
gaattcccgccgccaccatgaagtgggtgacctttattagcctgctgttcctgtttagttccgcatactcaagaggggtgtttagaagaagcgagagccctgtgaccatctccagggccggaaatgcaggagagctggtgtctcctctgctgctgccacctacacggagaaggcgccggagacacatccagggaccaggacctgtgctgaacctgccaagcgccgccgccgccccacccgtggccagagccccagaggcagcaggaggaggctccagatctgaggactatagctcctctccacacagcgccgccgccgccgcccggcccctggccgccgaggagaagcaggcccagtctctgcagcccagctcctctaggcgcagctcccactaccctgcagcagtgcagtcccaggctgccgccgagaggggagcctctgccaccgcaaagtctcgcgccatcagcatcctgcagaagaagccacgccaccagcagctgctgccctctctgtctagcttctttttcagccaccggctgcccgacatgaccgccatcatcaaggagatcgtgagcagaaataagcggcggtaccaggaggatggcttcgacctggatctgacatatatctaccccaacatcatcgccatgggatttcctgcagagcggctggagggcgtgtacagaaacaatatcgacgatgtggtgaggttcctggactccaagcacaagaaccactataagatctacaatctgtgcgccgagaggcactatgataccgccaagttcaactgtcgcgtggcccagtacccctttgaggaccacaatcctccacagctggagctgatcaagcctttctgcgaggacctggatcagtggctgtccgaggacgataatcacgtggcagcaatccactgcaaggcaggcaagggcaggacaggcgtgatgatctgtgcctatctgctgcaccgcggcaagttcctgaaggcccaggaggccctggacttttacggcgaggtgaggacccgcgataagaagggcgtgacaatcccaagccagcggcggtacgtgtactattactcctacctgctgaagaaccacctggactacaggccagtggccctgctgtttcacaagatgatgttcgagacaatccctatgttctccggcggcacatgcaacccacagtttgtggtgtgccagctgaaggtgaagatctattcctctaattctggcccaacccggagagaggataagttcatgtactttgagttcccacagccactgcccgtgtgcggcgacatcaaggtggagtttttccacaagcagaacaagatgctgaagaaggataagatgtttcacttctgggtgaatacctttttcatcccaggccccgaggagacatccgagaaggtggagaatggctctctgtgcgaccaggagatcgatagcatctgttccatcgagcgggccgacaacgataaggagtacctggtgctgaccctgacaaagaatgacctggataaggccaacaaggacaaggccaatagatacttcagccccaacttcaaggtgaagctgtacttcaccaagacagtggaggagccttccaatccagaggccagctcctctaccagcgtgacacctgacgtgtccgataacgagccagaccactatcggtactccgataccacagactctgatccagagaacgagccctttgacgaggatcagcacacccagatcacaaaggtgccattcgaggatcacgtgaagctggtgaatgaggtgaccgagtttgccaagacatgcgtggccgacgagagcgccgagaactgtgataagtccctgcacaccctgttcggcgacaagctgtgcaccgtggccacactgcgggagacatatggcgagatggccgattgctgtgccaaacaggagcctgagagaaatgagtgctttctgcagcacaaggacgataacccaaatctgcctaggctggtgcggcccgaggtggacgtgatgtgcaccgcctttcacgataacgaggagacattcctgaagaagtatctgtacgagatcgcccggagacacccctatttctacgcccctgagctgctgtttttcgccaagagatacaaggccgcctttaccgagtgctgtcaggcagcagacaaggcagcatgcctgctgccaaagctggacgagctgagggatgagggcaaggccagctccgccaagcagagactgaagtgtgccagcctgcagaagtttggagagagggccttcaaggcctgggcagtggcaaggctgagccagcggttcccaaaggcagagttcgcagaggtgtccaagctggtgaccgatctgacaaaggtgcacaccgagtgctgtcacggcgacctgctggagtgcgcagacgatagggcagatctggccaagtacatctgtgagaaccaggactctatctctagcaagctgaaggagtgctgtgagaagcccctgctggagaagagccactgcatcgccgaggtggagaatgacgagatgcctgccgatctgccatctctggccgccgacttcgtggagagcaaggacgtgtgcaagaactatgccgaggccaaggacgtgtttctgggcatgttcctgtatgagtacgccaggcgccaccccgattattccgtggtgctgctgctgcggctggccaagacctacgagacaaccctggagaagtgctgtgccgccgccgacccccacgagtgctacgcaaaggtgtttgacgagttcaagccactggtggaggagccccagaacctgatcaagcagaattgtgagctgttcgagcagctgggcgagtataagtttcagaatgccctgctggtgagatacacaaagaaggtgcctcaggtgtccaccccaacactggtggaggtgtctaggaacctgggcaaggtcggcagcaagtgctgtaagcacccagaggcaaagaggatgccttgcgccgaggactatctgtctgtggtgctgaaccagctgtgcgtgctgcacgagaagacccccgtgagcgatcgggtgaccaagtgctgtacagagtctctggtgaatagacggccctgcttcagcgccctggaggtggacgagacatacgtgccaaaggagtttaacgccgagacattcaccttccacgccgacatctgtaccctgtccgagaaggagagacagatcaagaagcagacagccctggtggagctggtgaagcacaagcctaaggccaccaaggagcagctgaaggccgtgatggacgattttgccgccttcgtggagaagtgctgtaaggccgacgataaggagacatgcttcgccgaggagggcaagaagctggtcgccgcttcacaggctgctctggggctgcatcaccaccaccaccactgataagcttggatcc

SEQ ID NO: 152 - DNA, 3357 bp, Artificial Sequence
  Description of Artificial Sequence: Synthetic polynucleotide
gaattcccgccgccaccatgaagtgggtgacctttattagcctgctgttcctgtttagttccgcatactcaagaggggtgtttagaagaagcgagagccctgtgaccatctccagggccggaaatgcaggagagctggtgtctcctctgctgctgccacctacacggagaaggcgccggagacacatccagggaccaggacctgtgctgaacctgccaagcgccgccgccgccccacccgtggccagagccccagaggcagcaggaggaggctccagatctgaggactatagctcctctccacacagcgccgccgccgccgcccggcccctggccgccgaggagaagcaggcccagtctctgcagcccagctcctctaggcgcagctcccactaccctgcagcagtgcagtcccaggctgccgccgagaggggagcctctgccaccgcaaagtctcgcgccatcagcatcctgcagaagaagccacgccaccagcagctgctgccctctctgtctagcttctttttcagccaccggctgcccgacatgaccgccatcatcaaggagatcgtgagcagaaataagcggcggtaccaggaggatggcttcgacctggatctgacatatatctaccccaacatcatcgccatgggatttcctgcagagcggctggagggcgtgtacagaaacaatatcgacgatgtggtgaggttcctggactccaagcacaagaaccactataagatctacaatctgtgcgccgagaggcactatgataccgccaagttcaactgtcgcgtggcccagtacccctttgaggaccacaatcctccacagctggagctgatcaagcctttctgcgaggacctggatcagtggctgtccgaggacgataatcacgtggcagcaatccactgcaaggcaggcaagggcaggacaggcgtgatgatctgtgcctatctgctgcaccgcggcaagttcctgaaggcccaggaggccctggacttttacggcgaggtgaggacccgcgataagaagggcgtgacaatcccaagccagcggcggtacgtgtactattactcctacctgctgaagaaccacctggactacaggccagtggccctgctgtttcacaagatgatgttcgagacaatccctatgttctccggcggcacatgcaacccacagtttgtggtgtgccagctgaaggtgaagatctattcctctaattctggcccaacccggagagaggataagttcatgtactttgagttcccacagccactgcccgtgtgcggcgacatcaaggtggagtttttccacaagcagaacaagatgctgaagaaggataagatgtttcacttctgggtgaatacctttttcatcccaggccccgaggagacatccgagaaggtggagaatggctctctgtgcgaccaggagatcgatagcatctgttccatcgagcgggccgacaacgataaggagtacctggtgctgaccctgacaaagaatgacctggataaggccaacaaggacaaggccaatagatacttcagccccaacttcaaggtgaagctgtacttcaccaagacagtggaggagccttccaatccagaggccagctcctctaccagcgtgacacctgacgtgtccgataacgagccagaccactatcggtactccgataccacagactctgatccagagaacgagccctttgacgaggatcagcacacccagatcacaaaggtggataagtccctgcacaccctgttcggcgacaagctgtgcaccgtggccacactgcgggagacatatggcgagatggccgattgctgtgccaaacaggagcctgagagaaatgagtgctttctgcagcacaaggacgataacccaaatctgcctaggctggtgcggcccgaggtggacgtgatgtgcaccgcctttcacgataacgaggagacattcctgaagaagtatctgtacgagatcgcccggagacacccctatttctacgcccctgagctgctgtttttcgccaagagatacaaggccgcctttaccgagtgctgtcaggcagcagacaaggcagcatgcctgctgccaaagctggacgagctgagggatgagggcaaggccagctccgccaagcagagactgaagtgtgccagcctgcagaagtttggagagagggccttcaaggcctgggcagtggcaaggctgagccagcggttcccaaaggcagagttcgcagaggtgtccaagctggtgaccgatctgacaaaggtgcacaccgagtgctgtcacggcgacctgctggagtgcgcagacgatagggcagatctggccaagtacatctgtgagaaccaggactctatctctagcaagctgaaggagtgctgtgagaagcccctgctggagaagagccactgcatcgccgaggtggagaatgacgagatgcctgccgatctgccatctctggccgccgacttcgtggagagcaaggacgtgtgcaagaactatgccgaggccaaggacgtgtttctgggcatgttcctgtatgagtacgccaggcgccaccccgattattccgtggtgctgctgctgcggctggccaagacctacgagacaaccctggagaagtgctgtgccgccgccgacccccacgagtgctacgcaaaggtgtttgacgagttcaagccactggtggaggagccccagaacctgatcaagcagaattgtgagctgttcgagcagctgggcgagtataagtttcagaatgccctgctggtgagatacacaaagaaggtgcctcaggtgtccaccccaacactggtggaggtgtctaggaacctgggcaaggtcggcagcaagtgctgtaagcacccagaggcaaagaggatgccttgcgccgaggactatctgtctgtggtgctgaaccagctgtgcgtgctgcacgagaagacccccgtgagcgatcgggtgaccaagtgctgtacagagtctctggtgaatagacggccctgcttcagcgccctggaggtggacgagacatacgtgccaaaggagtttaacgccgagacattcaccttccacgccgacatctgtaccctgtccgagaaggagagacagatcaagaagcagacagccctggtggagctggtgaagcacaagcctaaggccaccaaggagcagctgaaggccgtgatggacgattttgccgccttcgtggagaagtgctgtaaggccgacgataaggagacatgcttcgccgaggagggcaagaagctggtcgccgcttcacaggctgctctggggctgcatcaccaccaccaccactgataagcttggatcc

SEQ ID NO: 153 - DNA, 3084 bp, Artificial Sequence
  Description of Artificial Sequence: Synthetic polynucleotide
gaattcccgccgccaccatgaagtgggtgacctttattagcctgctgttcctgtttagttccgcatactcaagaggggtgtttagaagaaccgccatcatcaaggagatcgtgagcagaaataagcggcggtaccaggaggatggcttcgacctggatctgacatatatctaccccaacatcatcgccatgggatttcctgcagagcggctggagggcgtgtacagaaacaatatcgacgatgtggtgaggttcctggactccaagcacaagaaccactataagatctacaatctgtgcgccgagaggcactatgataccgccaagttcaactgtcgcgtggcccagtacccctttgaggaccacaatcctccacagctggagctgatcaagcctttctgcgaggacctggatcagtggctgtccgaggacgataatcacgtggcagcaatccactgcaaggcaggcaagggcaggacaggcgtgatgatctgtgcctatctgctgcaccgcggcaagttcctgaaggcccaggaggccctggacttttacggcgaggtgaggacccgcgataagaagggcgtgacaatcccaagccagcggcggtacgtgtactattactcctacctgctgaagaaccacctggactacaggccagtggccctgctgtttcacaagatgatgttcgagacaatccctatgttctccggcggcacatgcaacccacagtttgtggtgtgccagctgaaggtgaagatctattcctctaattctggcccaacccggagagaggataagttcatgtactttgagttcccacagccactgcccgtgtgcggcgacatcaaggtggagtttttccacaagcagaacaagatgctgaagaaggataagatgtttcacttctgggtgaatacctttttcatcccaggccccgaggagacatccgagaaggtggagaatggctctctgtgcgaccaggagatcgatagcatctgttccatcgagcgggccgacaacgataaggagtacctggtgctgaccctgacaaagaatgacctggataaggccaacaaggacaaggccaatagatacttcagccccaacttcaaggtgaagctgtacttcaccaagacagtggaggagccttccaatccagaggccagctcctctaccagcgtgacacctgacgtgtccgataacgagccagaccactatcggtactccgataccacagactctgatccagagaacgagccctttgacgaggatcagcacacccagatcacaaaggtggatgcccacaagagcgaggtggcccaccgctttaaggacctgggcgaggagaacttcaaggccctggtgctgatcgcctttgcccagtacctgcagcagtgcccattcgaggatcacgtgaagctggtgaatgaggtgaccgagtttgccaagacatgcgtggccgacgagagcgccgagaactgtgataagtccctgcacaccctgttcggcgacaagctgtgcaccgtggccacactgcgggagacatatggcgagatggccgattgctgtgccaaacaggagcctgagagaaatgagtgctttctgcagcacaaggacgataacccaaatctgcctaggctggtgcggcccgaggtggacgtgatgtgcaccgcctttcacgataacgaggagacattcctgaagaagtatctgtacgagatcgcccggagacacccctatttctacgcccctgagctgctgtttttcgccaagagatacaaggccgcctttaccgagtgctgtcaggcagcagacaaggcagcatgcctgctgccaaagctggacgagctgagggatgagggcaaggccagctccgccaagcagagactgaagtgtgccagcctgcagaagtttggagagagggccttcaaggcctgggcagtggcaaggctgagccagcggttcccaaaggcagagttcgcagaggtgtccaagctggtgaccgatctgacaaaggtgcacaccgagtgctgtcacggcgacctgctggagtgcgcagacgatagggcagatctggccaagtacatctgtgagaaccaggactctatctctagcaagctgaaggagtgctgtgagaagcccctgctggagaagagccactgcatcgccgaggtggagaatgacgagatgcctgccgatctgccatctctggccgccgacttcgtggagagcaaggacgtgtgcaagaactatgccgaggccaaggacgtgtttctgggcatgttcctgtatgagtacgccaggcgccaccccgattattccgtggtgctgctgctgcggctggccaagacctacgagacaaccctggagaagtgctgtgccgccgccgacccccacgagtgctacgcaaaggtgtttgacgagttcaagccactggtggaggagccccagaacctgatcaagcagaattgtgagctgttcgagcagctgggcgagtataagtttcagaatgccctgctggtgagatacacaaagaaggtgcctcaggtgtccaccccaacactggtggaggtgtctaggaacctgggcaaggtcggcagcaagtgctgtaagcacccagaggcaaagaggatgccttgcgccgaggactatctgtctgtggtgctgaaccagctgtgcgtgctgcacgagaagacccccgtgagcgatcgggtgaccaagtgctgtacagagtctctggtgaatagacggccctgcttcagcgccctggaggtggacgagacatacgtgccaaaggagtttaacgccgagacattcaccttccacgccgacatctgtaccctgtccgagaaggagagacagatcaagaagcagacagccctggtggagctggtgaagcacaagcctaaggccaccaaggagcagctgaaggccgtgatggacgattttgccgccttcgtggagaagtgctgtaaggccgacgataaggagacatgcttcgccgaggagggcaagaagctggtcgccgcttcacaggctgctctggggctgcatcaccaccaccaccactgataagcttggatcc

SEQ ID NO: 154 - DNA, 3081 bp, Artificial Sequence
  Description of Artificial Sequence: Synthetic polynucleotide
gaattcccgccgccaccatgaaatgggtcaccttcctcctcctgctgttcgtgtctggttccgcctttagccggggggtcttccgacgggaggctcacaagtccgagatcgcccacaggttcaaggacctgggagagcagcacttcaagggcctggtgctgatcgccttttctcagtacctgcagaagtgcccctacgaggagcacatcaagctggtgcaggaggtgaccgatttcgctaagacatgcgtggctgacgagaacgccgagaactgtgataagagcatccacacactgtttggagacaagctgtgcgccatccccaagctgagggacaactacggcgagctggctgattgctgtgccaagcaggagcctgagagaaacgagtgcttcctgcagcacaaggacgataaccccaacctgccaccttttcagcggcctgaggctgaggctatgtgcacctcttttcaggagaaccctacaagcttcctgggacactacctgcacgaggtggctcggcgccacccttacttctacgctccagagctgctgtactacgctgagaagtacaacgaggtgctgacccagtgctgtacagagagcgacaaggctgcctgcctgacccccaagctggatgctgtgaaggagaaggccctggtggctgccgtgcggcagcgcatgaagtgttctagcatgcagaggtttggagagagagccttcaaggcttgggctgtggctaggatgtcccagaggttccctaacgctgagttcgccgagatcaccaagctggccaccgacgtgacaaagatcaacaaggagtgctgtcacggcgatctgctggagtgcgctgacgatagagctgagctggccaagtacatgtgcgagaaccaggccacaatctcctctaagctgcaggcttgctgtgacaagccagtgctgcagaagagccagtgcctggccgagatcgagcacgacaacatcccagctgatctgccctccatcgctgccgacttcgtggaggataaggaggtgtgcaagaactacgctgaggccaaggacgtgttcctgggcaccttcctgtacgagtacagcaggagacaccccgactatagcgtgtccctgctgctgaggctggctaagaagtacgaggccaccctggagaagtgctgtgctgagggcgaccccccagcttgctacggaacagtgctggctgagttccagccactggtggaggagcctaagaacctggtgaagaccaactgtgagctgtacgagaagctgggagagtacggctttcagaacgccgtgctggtgagatacacacagaaggctccacaggtgtccacccccacactggtggaggctgccaggaacctgggaagagtgggcaccaagtgctgtacactgcctgaggctcagcggctgccatgcgtggaggattacctgtctgctatcctgaaccgcctgtgcgtgctgcacgagaagacccccgtgagcgagaaggtgacaaagtgctgttctggaagcctggtggagcggcgcccatgcttctccgccctgaccgtggacgagacatacgtgcccaaggagtttaaggctgagacattcaccttccactctgacatctgtaccctgccagataaggagaagcagatcaagaagcagacagctctggccgagctggtgaagcacaagcccaaggccaccgaggaccagctgaagacagtgatgggcgactttgctcagttcgtggataagtgctgtaaggctgccgacaaggataactgtttcgccaccgaaggtccaaatctcgtcgcccgctccaaagaagcactggctaccgccatcatcaaggagatcgtgagcagaaacaagaggagataccaggaggacggcttcgacctggatctgacatacatctaccctaacatcatcgctatgggatttccagctgagcggctggagggcgtgtacaggaacaacatcgacgatgtggtgcggttcctggactccaagcacaagaaccactacaagatctacaacctgtgcgctgagaggcactacgacaccgccaagttcaactgtagagtggctcagtacccttttgaggatcacaaccctccacagctggagctgatcaagccattctgcgaggacctggatcagtggctgagcgaggacgataaccacgtggctgccatccactgcaaggccggaaagggccggacaggagtgatgatctgtgcttacctgctgcaccgcggcaagttcctgaaggctcaggaggccctggacttttacggagaggtgaggaccagagataagaagggcgtgacaatcccttcccagcggcgctacgtgtactactactcttacctgctgaagaaccacctggactaccgcccagtggccctgctgtttcacaagatgatgttcgagacaatcccaatgttctctggaggcacatgcaacccccagtttgtggtgtgccagctgaaggtgaagatctacagctccaacagcggaccaaccaggagagaggacaagttcatgtactttgagttcccacagcctctgcccgtgtgcggcgatatcaaggtggagtttttccacaagcagaacaagatgctgaagaaggacaagatgtttcacttctgggtcaacacctttttcatccccggacctgaggagacaagcgagaaggtggagaacggctccctgtgcgaccaggagatcgattctatctgtagcatcgagcgggccgacaacgataaggagtacctggtgctgaccctgacaaagaacgacctggataaggctaacaaggataaggccaaccgctacttttcccccaacttcaaggtgaagctgtacttcaccaagacagtggaggagccttctaacccagaggcctctagctccacctctgtgacaccagacgtgagcgataacgagcccgaccactacaggtacagcgataccacagactccgatcccgagaacgagccttttgacgaggatcagcacagccagatcaccaaggtgcatcatcaccatcatcattgataagcttggatcc

SEQ ID NO: 155 - DNA, 2472 bp, Artificial Sequence
  Description of Artificial Sequence: Synthetic polynucleotide
gaattcccgccgccaccatgaaatgggtcaccttcctcctcctgctgttcgtgtctggttccgcctttagccggggggtcttccgacgggaggctcacaagtccgagatcgcccacaggttcaaggacctgggagagcagcacttcaagggcctggtgctgatcgccttttctcagtacctgcagaagtgcccctacgaggagcacatcaagctggtgcaggaggtgaccgatttcgctaagacatgcgtggctgacgagaacgccgagaactgtgataagagcatccacacactgtttggagacaagctgtgcgccatccccaagctgagggacaactacggcgagctggctgattgctgtgccaagcaggagcctgagagaaacgagtgcttcctgcagcacaaggacgataaccccaacctgccaccttttcagcggcctgaggctgaggctatgtgcacctcttttcaggagaaccctacaagcttcctgggacactacctgcacgaggtggctcggcgccacccttacttctacgctccagagctgctgtactacgctgagaagtacaacgaggtgctgacccagtgctgtacagagagcgacaaggctgcctgcctgacccccaagctggatgctgtgaaggagaaggccctggtggctgccgtgcggcagcgcatgaagtgttctagcatgcagaggtttggagagagagccttcaaggcttgggctgtggctaggatgtcccagaggttccctaacgctgagttcgccgagatcaccaagctggccaccgacgtgacaaagatcaacaaggagtgctgtcacggcgatctgctggagtgcgctgacgatagagctgagctggccaagtacatgtgcgagaaccaggccacaatctcctctaagctgcaggcttgctgtgacaagccagtgctgcagaagagccagtgcctggccgagatcgagcacgacaacatcccagctgatctgccctccatcgctgccgacttcgtggaggataaggaggtgtgcaagaactacgctgaggccaaggacgtgttcctgggcaccttcctgtacgagtacagcaggagacaccccgactatagcgtgtccctgctgctgaggctggctaagaagtacgaggccaccctggagaagtgctgtgctgagggcgaccccccagcttgctacggaacagtgctggctgagttccagccactggtgaccgccatcatcaaggagatcgtgagcagaaacaagaggagataccaggaggacggcttcgacctggatctgacatacatctaccctaacatcatcgctatgggatttccagctgagcggctggagggcgtgtacaggaacaacatcgacgatgtggtgcggttcctggactccaagcacaagaaccactacaagatctacaacctgtgcgctgagaggcactacgacaccgccaagttcaactgtagagtggctcagtacccttttgaggatcacaaccctccacagctggagctgatcaagccattctgcgaggacctggatcagtggctgagcgaggacgataaccacgtggctgccatccactgcaaggccggaaagggccggacaggagtgatgatctgtgcttacctgctgcaccgcggcaagttcctgaaggctcaggaggccctggacttttacggagaggtgaggaccagagataagaagggcgtgacaatcccttcccagcggcgctacgtgtactactactcttacctgctgaagaaccacctggactaccgcccagtggccctgctgtttcacaagatgatgttcgagacaatcccaatgttctctggaggcacatgcaacccccagtttgtggtgtgccagctgaaggtgaagatctacagctccaacagcggaccaaccaggagagaggacaagttcatgtactttgagttcccacagcctctgcccgtgtgcggcgatatcaaggtggagtttttccacaagcagaacaagatgctgaagaaggacaagatgtttcacttctgggtcaacacctttttcatccccggacctgaggagacaagcgagaaggtggagaacggctccctgtgcgaccaggagatcgattctatctgtagcatcgagcgggccgacaacgataaggagtacctggtgctgaccctgacaaagaacgacctggataaggctaacaaggataaggccaaccgctacttttcccccaacttcaaggtgaagctgtacttcaccaagacagtggaggagccttctaacccagaggcctctagctccacctctgtgacaccagacgtgagcgataacgagcccgaccactacaggtacagcgataccacagactccgatcccgagaacgagccttttgacgaggatcagcacagccagatcaccaaggtgcatcatcaccatcatcattgataagcttggatcc

SEQ ID NO: 156 - DNA, 3081 bp, Artificial Sequence
  Description of Artificial Sequence: Synthetic polynucleotide
gaattcccgccgccaccatgaaatgggtcaccttcctcctcctgctgttcgtgtctggttccgcctttagccggggggtcttccgacgggaggctcacaaaagcgagattgcccatagatacaacgacctgggggaacagcatttcaagggactggtcctgattgcattttcacagtacctgcagaagtgcagctatgacgagcacgccaagctggtgcaggaggtgaccgatttcgccaagacatgcgtggcagacgagtccgccgcaaactgtgataagtctctgcacaccctgtttggcgacaagctgtgcgccatccccaacctgcgggagaattatggcgagctggccgattgctgtacaaagcaggagcctgagcgcaacgagtgcttcctgcagcacaaggacgataatccaagcctgccaccttttgagcggcccgaggcagaggcaatgtgcacctccttcaaggagaacccaaccaccttcatgggccactacctgcacgaggtggccaggagacacccctacttctatgcccctgagctgctgtactatgccgagcagtataatgagatcctgacccagtgctgtgccgaggccgacaaggagagctgcctgacacctaagctggatggcgtgaaggagaaggccctggtgagctccgtgcggcagcgcatgaagtgttctagcatgcagaagttcggcgagagggcctttaaggcatgggcagtggcaaggctgtcccagaccttcccaaacgccgactttgccgagatcacaaagctggccaccgatctgacaaaagtgaataaggagtgctgtcacggcgacctgctggagtgcgcagacgatagggcagagctggccaagtatatgtgcgagaaccaggccaccatctcctctaagctgcagacatgctgtgataagcccctgctgaagaaggcccactgcctgtctgaggtggagcacgacaccatgcctgcagatctgccagcaatcgcagcagacttcgtggaggatcaggaggtgtgcaagaactacgccgaggccaaggacgtgttcctgggcacctttctgtacgagtattcccggcgccaccctgattacagcgtgtccctgctgctgaggctggccaagaagtatgaggccaccctggagaagtgctgtgcagaggcaaatccaccagcatgctacggaacagtgctggcagagttccagccactggtggaggagcccaagaacctggtgaagaccaattgtgacctgtacgagaagctgggcgagtatggctttcagaacgccatcctggtgagatatacacagaaggcccctcaggtgtccaccccaacactggtggaggccgccaggaatctgggcagagtgggcaccaagtgctgtacactgcccgaggaccagaggctgccttgcgtggaggattacctgtctgccatcctgaatagggtgtgcctgctgcacgagaagacccctgtgagcgagcacgtgacaaagtgctgttctggcagcctggtggagaggaggccctgcttctccgccctgaccgtggacgagacatacgtgccaaaggagtttaaggccgagactttcacgtttcactctgatatctgtaccctgccagagaaggagaagcagatcaagaagcagacagccctggccgagctggtgaagcacaagcccaaggccaccgccgagcagctgaagacagtgatggacgatttcgcccagtttctggacacctgctgtaaggccgccgataaggacacctgtttctccactgaggggcctaatctggtcacacgctgtaaagacgcactggcaaccgccatcatcaaggagatcgtgagcagaaacaagaggagataccaggaggacggcttcgacctggatctgacatacatctaccctaacatcatcgctatgggatttccagctgagcggctggagggcgtgtacaggaacaacatcgacgatgtggtgcggttcctggactccaagcacaagaaccactacaagatctacaacctgtgcgctgagaggcactacgacaccgccaagttcaactgtagagtggctcagtacccttttgaggatcacaaccctccacagctggagctgatcaagccattctgcgaggacctggatcagtggctgagcgaggacgataaccacgtggctgccatccactgcaaggccggaaagggccggacaggagtgatgatctgtgcttacctgctgcaccgcggcaagttcctgaaggctcaggaggccctggacttttacggagaggtgaggaccagagataagaagggcgtgacaatcccttcccagcggcgctacgtgtactactactcttacctgctgaagaaccacctggactaccgcccagtggccctgctgtttcacaagatgatgttcgagacaatcccaatgttctctggaggcacatgcaacccccagtttgtggtgtgccagctgaaggtgaagatctacagctccaacagcggaccaaccaggagagaggacaagttcatgtactttgagttcccacagcctctgcccgtgtgcggcgatatcaaggtggagtttttccacaagcagaacaagatgctgaagaaggacaagatgtttcacttctgggtcaacacctttttcatccccggacctgaggagacaagcgagaaggtggagaacggctccctgtgcgaccaggagatcgattctatctgtagcatcgagcgggccgacaacgataaggagtacctggtgctgaccctgacaaagaacgacctggataaggctaacaaggataaggccaaccgctacttttcccccaacttcaaggtgaagctgtacttcaccaagacagtggaggagccttctaacccagaggcctctagctccacctctgtgacaccagacgtgagcgataacgagcccgaccactacaggtacagcgataccacagactccgatcccgagaacgagccttttgacgaggatcagcacagccagatcaccaaggtgcatcatcaccatcatcattgataagcttggatcc

SEQ ID NO: 157 - DNA, 3567 bp, Artificial Sequence
  Description of Artificial Sequence: Synthetic polynucleotide
gaattcccgccgccaccatgaagtgggtgacctttattagcctgctgttcctgtttagttccgcatactcaagaggggtgtttagaagaagcgagagccctgtgaccatctccagggccggaaatgcaggagagctggtgtctcctctgctgctgccacctacacggagaaggcgccggagacacatccagggaccaggacctgtgctgaacctgccaagcgccgccgccgccccacccgtggccagagccccagaggcagcaggaggaggctccagatctgaggactatagctcctctccacacagcgccgccgccgccgcccggcccctggccgccgaggagaagcaggcccagtctctgcagcccagctcctctaggcgcagctcccactaccctgcagcagtgcagtcccaggctgccgccgagaggggagcctctgccaccgcaaagtctcgcgccatcagcatcctgcagaagaagccacgccaccagcagctgctgccctctctgtctagcttctttttcagccaccggctgcccgacatgaccgccatcatcaaggagatcgtgagcagaaataagcggcggtaccaggaggatggcttcgacctggatctgacatatatctaccccaacatcatcgccatgggatttcctgcagagcggctggagggcgtgtacagaaacaatatcgacgatgtggtgaggttcctggactccaagcacaagaaccactataagatctacaatctgtgcgccgagaggcactatgataccgccaagttcaactgtcgcgtggcccagtacccctttgaggaccacaatcctccacagctggagctgatcaagcctttctgcgaggacctggatcagtggctgtccgaggacgataatcacgtggcagcaatccactgcaaggcaggcaagggcaggacaggcgtgatgatctgtgcctatctgctgcaccgcggcaagttcctgaaggcccaggaggccctggacttttacggcgaggtgaggacccgcgataagaagggcgtgacaatcccaagccagcggcggtacgtgtactattactcctacctgctgaagaaccacctggactacaggccagtggccctgctgtttcacaagatgatgttcgagacaatccctatgttctccggcggcacatgcaacccacagtttgtggtgtgccagctgaaggtgaagatctattcctctaattctggcccaacccggagagaggataagttcatgtactttgagttcccacagccactgcccgtgtgcggcgacatcaaggtggagtttttccacaagcagaacaagatgctgaagaaggataagatgtttcacttctgggtgaatacctttttcatcccaggccccgaggagacatccgagaaggtggagaatggctctctgtgcgaccaggagatcgatagcatctgttccatcgagcgggccgacaacgataaggagtacctggtgctgaccctgacaaagaatgacctggataaggccaacaaggacaaggccaatagatacttcagccccaacttcaaggtgaagctgtacttcaccaagacagtggaggagccttccaatccagaggccagctcctctaccagcgtgacacctgacgtgtccgataacgagccagaccactatcggtactccgataccacagactctgatccagagaacgagccctttgacgaggatcagcacacccagatcacaaaggtgggccccgccgccctgaaggcagccgatgcccacaagagcgaggtggcccaccgctttaaggacctgggcgaggagaacttcaaggccctggtgctgatcgcctttgcccagtacctgcagcagtgcccattcgaggatcacgtgaagctggtgaatgaggtgaccgagtttgccaagacatgcgtggccgacgagagcgccgagaactgtgataagtccctgcacaccctgttcggcgacaagctgtgcaccgtggccacactgcgggagacatatggcgagatggccgattgctgtgccaaacaggagcctgagagaaatgagtgctttctgcagcacaaggacgataacccaaatctgcctaggctggtgcggcccgaggtggacgtgatgtgcaccgcctttcacgataacgaggagacattcctgaagaagtatctgtacgagatcgcccggagacacccctatttctacgcccctgagctgctgtttttcgccaagagatacaaggccgcctttaccgagtgctgtcaggcagcagacaaggcagcatgcctgctgccaaagctggacgagctgagggatgagggcaaggccagctccgccaagcagagactgaagtgtgccagcctgcagaagtttggagagagggccttcaaggcctgggcagtggcaaggctgagccagcggttcccaaaggcagagttcgcagaggtgtccaagctggtgaccgatctgacaaaggtgcacaccgagtgctgtcacggcgacctgctggagtgcgcagacgatagggcagatctggccaagtacatctgtgagaaccaggactctatctctagcaagctgaaggagtgctgtgagaagcccctgctggagaagagccactgcatcgccgaggtggagaatgacgagatgcctgccgatctgccatctctggccgccgacttcgtggagagcaaggacgtgtgcaagaactatgccgaggccaaggacgtgtttctgggcatgttcctgtatgagtacgccaggcgccaccccgattattccgtggtgctgctgctgcggctggccaagacctacgagacaaccctggagaagtgctgtgccgccgccgacccccacgagtgctacgcaaaggtgtttgacgagttcaagccactggtggaggagccccagaacctgatcaagcagaattgtgagctgttcgagcagctgggcgagtataagtttcagaatgccctgctggtgagatacacaaagaaggtgcctcaggtgtccaccccaacactggtggaggtgtctaggaacctgggcaaggtcggcagcaagtgctgtaagcacccagaggcaaagaggatgccttgcgccgaggactatctgtctgtggtgctgaaccagctgtgcgtgctgcacgagaagacccccgtgagcgatcgggtgaccaagtgctgtacagagtctctggtgaatagacggccctgcttcagcgccctggaggtggacgagacatacgtgccaaaggagtttaacgccgagacattcaccttccacgccgacatctgtaccctgtccgagaaggagagacagatcaagaagcagacagccctggtggagctggtgaagcacaagcctaaggccaccaaggagcagctgaaggccgtgatggacgattttgccgccttcgtggagaagtgctgtaaggccgacgataaggagacatgcttcgccgaggagggcaagaagctggtcgccgcttcacaggctgctctggggctgcatcaccaccaccaccactgataagcttggatcc

SEQ ID NO: 158 - DNA, 3558 bp, Artificial Sequence
  Description of Artificial Sequence: Synthetic polynucleotide
gaattcccgccgccaccatgaagtgggtgacctttattagcctgctgttcctgtttagttccgcatactcaagaggggtgtttagaagaagcgagagccctgtgaccatctccagggccggaaatgcaggagagctggtgtctcctctgctgctgccacctacacggagaaggcgccggagacacatccagggaccaggacctgtgctgaacctgccaagcgccgccgccgccccacccgtggccagagccccagaggcagcaggaggaggctccagatctgaggactatagctcctctccacacagcgccgccgccgccgcccggcccctggccgccgaggagaagcaggcccagtctctgcagcccagctcctctaggcgcagctcccactaccctgcagcagtgcagtcccaggctgccgccgagaggggagcctctgccaccgcaaagtctcgcgccatcagcatcctgcagaagaagccacgccaccagcagctgctgccctctctgtctagcttctttttcagccaccggctgcccgacatgaccgccatcatcaaggagatcgtgagcagaaataagcggcggtaccaggaggatggcttcgacctggatctgacatatatctaccccaacatcatcgccatgggatttcctgcagagcggctggagggcgtgtacagaaacaatatcgacgatgtggtgaggttcctggactccaagcacaagaaccactataagatctacaatctgtgcgccgagaggcactatgataccgccaagttcaactgtcgcgtggcccagtacccctttgaggaccacaatcctccacagctggagctgatcaagcctttctgcgaggacctggatcagtggctgtccgaggacgataatcacgtggcagcaatccactgcaaggcaggcaagggcaggacaggcgtgatgatctgtgcctatctgctgcaccgcggcaagttcctgaaggcccaggaggccctggacttttacggcgaggtgaggacccgcgataagaagggcgtgacaatcccaagccagcggcggtacgtgtactattactcctacctgctgaagaaccacctggactacaggccagtggccctgctgtttcacaagatgatgttcgagacaatccctatgttctccggcggcacatgcaacccacagtttgtggtgtgccagctgaaggtgaagatctattcctctaattctggcccaacccggagagaggataagttcatgtactttgagttcccacagccactgcccgtgtgcggcgacatcaaggtggagtttttccacaagcagaacaagatgctgaagaaggataagatgtttcacttctgggtgaatacctttttcatcccaggccccgaggagacatccgagaaggtggagaatggctctctgtgcgaccaggagatcgatagcatctgttccatcgagcgggccgacaacgataaggagtacctggtgctgaccctgacaaagaatgacctggataaggccaacaaggacaaggccaatagatacttcagccccaacttcaaggtgaagctgtacttcaccaagacagtggaggagccttccaatccagaggccagctcctctaccagcgtgacacctgacgtgtccgataacgagccagaccactatcggtactccgataccacagactctgatccagagaacgagccctttgacgaggatcagcacacccagatcacaaaggtgggcggagctggctccgatgcccacaagagcgaggtggcccaccgctttaaggacctgggcgaggagaacttcaaggccctggtgctgatcgcctttgcccagtacctgcagcagtgcccattcgaggatcacgtgaagctggtgaatgaggtgaccgagtttgccaagacatgcgtggccgacgagagcgccgagaactgtgataagtccctgcacaccctgttcggcgacaagctgtgcaccgtggccacactgcgggagacatatggcgagatggccgattgctgtgccaaacaggagcctgagagaaatgagtgctttctgcagcacaaggacgataacccaaatctgcctaggctggtgcggcccgaggtggacgtgatgtgcaccgcctttcacgataacgaggagacattcctgaagaagtatctgtacgagatcgcccggagacacccctatttctacgcccctgagctgctgtttttcgccaagagatacaaggccgcctttaccgagtgctgtcaggcagcagacaaggcagcatgcctgctgccaaagctggacgagctgagggatgagggcaaggccagctccgccaagcagagactgaagtgtgccagcctgcagaagtttggagagagggccttcaaggcctgggcagtggcaaggctgagccagcggttcccaaaggcagagttcgcagaggtgtccaagctggtgaccgatctgacaaaggtgcacaccgagtgctgtcacggcgacctgctggagtgcgcagacgatagggcagatctggccaagtacatctgtgagaaccaggactctatctctagcaagctgaaggagtgctgtgagaagcccctgctggagaagagccactgcatcgccgaggtggagaatgacgagatgcctgccgatctgccatctctggccgccgacttcgtggagagcaaggacgtgtgcaagaactatgccgaggccaaggacgtgtttctgggcatgttcctgtatgagtacgccaggcgccaccccgattattccgtggtgctgctgctgcggctggccaagacctacgagacaaccctggagaagtgctgtgccgccgccgacccccacgagtgctacgcaaaggtgtttgacgagttcaagccactggtggaggagccccagaacctgatcaagcagaattgtgagctgttcgagcagctgggcgagtataagtttcagaatgccctgctggtgagatacacaaagaaggtgcctcaggtgtccaccccaacactggtggaggtgtctaggaacctgggcaaggtcggcagcaagtgctgtaagcacccagaggcaaagaggatgccttgcgccgaggactatctgtctgtggtgctgaaccagctgtgcgtgctgcacgagaagacccccgtgagcgatcgggtgaccaagtgctgtacagagtctctggtgaatagacggccctgcttcagcgccctggaggtggacgagacatacgtgccaaaggagtttaacgccgagacattcaccttccacgccgacatctgtaccctgtccgagaaggagagacagatcaagaagcagacagccctggtggagctggtgaagcacaagcctaaggccaccaaggagcagctgaaggccgtgatggacgattttgccgccttcgtggagaagtgctgtaaggccgacgataaggagacatgcttcgccgaggagggcaagaagctggtcgccgcttcacaggctgctctggggctgcatcaccaccaccaccactgataagcttggatcc

SEQ ID NO: 159 - DNA, 3555 bp, Artificial Sequence
  Description of Artificial Sequence: Synthetic polynucleotide
gaattcccgccgccaccatgaagtgggtgacctttattagcctgctgttcctgtttagttccgcatactcaagaggggtgtttagaagaagcgagagccctgtgaccatctccagggccggaaatgcaggagagctggtgtctcctctgctgctgccacctacacggagaaggcgccggagacacatccagggaccaggacctgtgctgaacctgccaagcgccgccgccgccccacccgtggccagagccccagaggcagcaggaggaggctccagatctgaggactatagctcctctccacacagcgccgccgccgccgcccggcccctggccgccgaggagaagcaggcccagtctctgcagcccagctcctctaggcgcagctcccactaccctgcagcagtgcagtcccaggctgccgccgagaggggagcctctgccaccgcaaagtctcgcgccatcagcatcctgcagaagaagccacgccaccagcagctgctgccctctctgtctagcttctttttcagccaccggctgcccgacatgaccgccatcatcaaggagatcgtgagcagaaataagcggcggtaccaggaggatggcttcgacctggatctgacatatatctaccccaacatcatcgccatgggatttcctgcagagcggctggagggcgtgtacagaaacaatatcgacgatgtggtgaggttcctggactccaagcacaagaaccactataagatctacaatctgtgcgccgagaggcactatgataccgccaagttcaactgtcgcgtggcccagtacccctttgaggaccacaatcctccacagctggagctgatcaagcctttctgcgaggacctggatcagtggctgtccgaggacgataatcacgtggcagcaatccactgcaaggcaggcaagggcaggacaggcgtgatgatctgtgcctatctgctgcaccgcggcaagttcctgaaggcccaggaggccctggacttttacggcgaggtgaggacccgcgataagaagggcgtgacaatcccaagccagcggcggtacgtgtactattactcctacctgctgaagaaccacctggactacaggccagtggccctgctgtttcacaagatgatgttcgagacaatccctatgttctccggcggcacatgcaacccacagtttgtggtgtgccagctgaaggtgaagatctattcctctaattctggcccaacccggagagaggataagttcatgtactttgagttcccacagccactgcccgtgtgcggcgacatcaaggtggagtttttccacaagcagaacaagatgctgaagaaggataagatgtttcacttctgggtgaatacctttttcatcccaggccccgaggagacatccgagaaggtggagaatggctctctgtgcgaccaggagatcgatagcatctgttccatcgagcgggccgacaacgataaggagtacctggtgctgaccctgacaaagaatgacctggataaggccaacaaggacaaggccaatagatacttcagccccaacttcaaggtgaagctgtacttcaccaagacagtggaggagccttccaatccagaggccagctcctctaccagcgtgacacctgacgtgtccgataacgagccagaccactatcggtactccgataccacagactctgatccagagaacgagccctttgacgaggatcagcacacccagatcacaaaggtgggcttcgtgggcgatgcccacaagagcgaggtggcccaccgctttaaggacctgggcgaggagaacttcaaggccctggtgctgatcgcctttgcccagtacctgcagcagtgcccattcgaggatcacgtgaagctggtgaatgaggtgaccgagtttgccaagacatgcgtggccgacgagagcgccgagaactgtgataagtccctgcacaccctgttcggcgacaagctgtgcaccgtggccacactgcgggagacatatggcgagatggccgattgctgtgccaaacaggagcctgagagaaatgagtgctttctgcagcacaaggacgataacccaaatctgcctaggctggtgcggcccgaggtggacgtgatgtgcaccgcctttcacgataacgaggagacattcctgaagaagtatctgtacgagatcgcccggagacacccctatttctacgcccctgagctgctgtttttcgccaagagatacaaggccgcctttaccgagtgctgtcaggcagcagacaaggcagcatgcctgctgccaaagctggacgagctgagggatgagggcaaggccagctccgccaagcagagactgaagtgtgccagcctgcagaagtttggagagagggccttcaaggcctgggcagtggcaaggctgagccagcggttcccaaaggcagagttcgcagaggtgtccaagctggtgaccgatctgacaaaggtgcacaccgagtgctgtcacggcgacctgctggagtgcgcagacgatagggcagatctggccaagtacatctgtgagaaccaggactctatctctagcaagctgaaggagtgctgtgagaagcccctgctggagaagagccactgcatcgccgaggtggagaatgacgagatgcctgccgatctgccatctctggccgccgacttcgtggagagcaaggacgtgtgcaagaactatgccgaggccaaggacgtgtttctgggcatgttcctgtatgagtacgccaggcgccaccccgattattccgtggtgctgctgctgcggctggccaagacctacgagacaaccctggagaagtgctgtgccgccgccgacccccacgagtgctacgcaaaggtgtttgacgagttcaagccactggtggaggagccccagaacctgatcaagcagaattgtgagctgttcgagcagctgggcgagtataagtttcagaatgccctgctggtgagatacacaaagaaggtgcctcaggtgtccaccccaacactggtggaggtgtctaggaacctgggcaaggtcggcagcaagtgctgtaagcacccagaggcaaagaggatgccttgcgccgaggactatctgtctgtggtgctgaaccagctgtgcgtgctgcacgagaagacccccgtgagcgatcgggtgaccaagtgctgtacagagtctctggtgaatagacggccctgcttcagcgccctggaggtggacgagacatacgtgccaaaggagtttaacgccgagacattcaccttccacgccgacatctgtaccctgtccgagaaggagagacagatcaagaagcagacagccctggtggagctggtgaagcacaagcctaaggccaccaaggagcagctgaaggccgtgatggacgattttgccgccttcgtggagaagtgctgtaaggccgacgataaggagacatgcttcgccgaggagggcaagaagctggtcgccgcttcacaggctgctctggggctgcatcaccaccaccaccactgataagcttggatcc

SEQ ID NO: 160 - DNA, 3558 bp, Artificial Sequence
  Description of Artificial Sequence: Synthetic polynucleotide
gaattcccgccgccaccatgaagtgggtgacctttattagcctgctgttcctgtttagttccgcatactcaagaggggtgtttagaagaagcgagagccctgtgaccatctccagggccggaaatgcaggagagctggtgtctcctctgctgctgccacctacacggagaaggcgccggagacacatccagggaccaggacctgtgctgaacctgccaagcgccgccgccgccccacccgtggccagagccccagaggcagcaggaggaggctccagatctgaggactatagctcctctccacacagcgccgccgccgccgcccggcccctggccgccgaggagaagcaggcccagtctctgcagcccagctcctctaggcgcagctcccactaccctgcagcagtgcagtcccaggctgccgccgagaggggagcctctgccaccgcaaagtctcgcgccatcagcatcctgcagaagaagccacgccaccagcagctgctgccctctctgtctagcttctttttcagccaccggctgcccgacatgaccgccatcatcaaggagatcgtgagcagaaataagcggcggtaccaggaggatggcttcgacctggatctgacatatatctaccccaacatcatcgccatgggatttcctgcagagcggctggagggcgtgtacagaaacaatatcgacgatgtggtgaggttcctggactccaagcacaagaaccactataagatctacaatctgtgcgccgagaggcactatgataccgccaagttcaactgtcgcgtggcccagtacccctttgaggaccacaatcctccacagctggagctgatcaagcctttctgcgaggacctggatcagtggctgtccgaggacgataatcacgtggcagcaatccactgcaaggcaggcaagggcaggacaggcgtgatgatctgtgcctatctgctgcaccgcggcaagttcctgaaggcccaggaggccctggacttttacggcgaggtgaggacccgcgataagaagggcgtgacaatcccaagccagcggcggtacgtgtactattactcctacctgctgaagaaccacctggactacaggccagtggccctgctgtttcacaagatgatgttcgagacaatccctatgttctccggcggcacatgcaacccacagtttgtggtgtgccagctgaaggtgaagatctattcctctaattctggcccaacccggagagaggataagttcatgtactttgagttcccacagccactgcccgtgtgcggcgacatcaaggtggagtttttccacaagcagaacaagatgctgaagaaggataagatgtttcacttctgggtgaatacctttttcatcccaggccccgaggagacatccgagaaggtggagaatggctctctgtgcgaccaggagatcgatagcatctgttccatcgagcgggccgacaacgataaggagtacctggtgctgaccctgacaaagaatgacctggataaggccaacaaggacaaggccaatagatacttcagccccaacttcaaggtgaagctgtacttcaccaagacagtggaggagccttccaatccagaggccagctcctctaccagcgtgacacctgacgtgtccgataacgagccagaccactatcggtactccgataccacagactctgatccagagaacgagccctttgacgaggatcagcacacccagatcacaaaggtgttcggcttcgtgggcgatgcccacaagagcgaggtggcccaccgctttaaggacctgggcgaggagaacttcaaggccctggtgctgatcgcctttgcccagtacctgcagcagtgcccattcgaggatcacgtgaagctggtgaatgaggtgaccgagtttgccaagacatgcgtggccgacgagagcgccgagaactgtgataagtccctgcacaccctgttcggcgacaagctgtgcaccgtggccacactgcgggagacatatggcgagatggccgattgctgtgccaaacaggagcctgagagaaatgagtgctttctgcagcacaaggacgataacccaaatctgcctaggctggtgcggcccgaggtggacgtgatgtgcaccgcctttcacgataacgaggagacattcctgaagaagtatctgtacgagatcgcccggagacacccctatttctacgcccctgagctgctgtttttcgccaagagatacaaggccgcctttaccgagtgctgtcaggcagcagacaaggcagcatgcctgctgccaaagctggacgagctgagggatgagggcaaggccagctccgccaagcagagactgaagtgtgccagcctgcagaagtttggagagagggccttcaaggcctgggcagtggcaaggctgagccagcggttcccaaaggcagagttcgcagaggtgtccaagctggtgaccgatctgacaaaggtgcacaccgagtgctgtcacggcgacctgctggagtgcgcagacgatagggcagatctggccaagtacatctgtgagaaccaggactctatctctagcaagctgaaggagtgctgtgagaagcccctgctggagaagagccactgcatcgccgaggtggagaatgacgagatgcctgccgatctgccatctctggccgccgacttcgtggagagcaaggacgtgtgcaagaactatgccgaggccaaggacgtgtttctgggcatgttcctgtatgagtacgccaggcgccaccccgattattccgtggtgctgctgctgcggctggccaagacctacgagacaaccctggagaagtgctgtgccgccgccgacccccacgagtgctacgcaaaggtgtttgacgagttcaagccactggtggaggagccccagaacctgatcaagcagaattgtgagctgttcgagcagctgggcgagtataagtttcagaatgccctgctggtgagatacacaaagaaggtgcctcaggtgtccaccccaacactggtggaggtgtctaggaacctgggcaaggtcggcagcaagtgctgtaagcacccagaggcaaagaggatgccttgcgccgaggactatctgtctgtggtgctgaaccagctgtgcgtgctgcacgagaagacccccgtgagcgatcgggtgaccaagtgctgtacagagtctctggtgaatagacggccctgcttcagcgccctggaggtggacgagacatacgtgccaaaggagtttaacgccgagacattcaccttccacgccgacatctgtaccctgtccgagaaggagagacagatcaagaagcagacagccctggtggagctggtgaagcacaagcctaaggccaccaaggagcagctgaaggccgtgatggacgattttgccgccttcgtggagaagtgctgtaaggccgacgataaggagacatgcttcgccgaggagggcaagaagctggtcgccgcttcacaggctgctctggggctgcatcaccaccaccaccactgataagcttggatcc

SEQ ID NO: 161 - DNA, 3504 bp, Artificial Sequence
  Description of Artificial Sequence: Synthetic polynucleotide
gaattcgccaccatgaagtgggtcacctttatttctctgctgtttctgttctccagtgcctattcccgtggggtctttcgtcgttccgagtcacctgtgaccatcagcagggctggaaacgctggagagctggtgtctccactgctgctgccacctacaaggaggagaaggaggaggcacatccagggaccaggaccagtgctgaatctgccatccgccgctgccgctccacccgtggctagggctccagaggctgctggaggaggctctagatccgaggattactccagctctcctcactccgctgctgctgctgccagaccactggctgctgaggagaagcaggctcagagcctgcagccctccagctctagacgctccagccattatcctgctgctgtgcagagccaggctgctgctgagaggggagcttctgccaccgctaagagcagggccatctctatcctgcagaagaagccacgccaccagcagctgctgccctctctgtcttccttctttttctcccataggctgcctgacatggaggagccccagtctgatccttccgtggagcctccactgtctcaggagacattctccgacctgtggaagctgctgcccgagaacaatgtgctgtcccctctgccaagccaggctatggacgatctgatgctgagccctgacgatatcgagcagtggtttaccgaggaccccggccctgatgaggctccaaggatgccagaggctgctccacctgtggccccagctcccgccgctcctacaccagctgctccagctcctgctccatcttggcctctgagctcttccgtgccaagccagaagacctaccagggctcttatggctttagactgggcttcctgcacagcggcacagccaagtctgtgacctgcacatactccccagctctgaacaagatgttctgccagctggccaagacctgtcccgtgcagctgtgggtggattctaccccaccacctggaacaagggtgcgggctatggctatctataagcagtcccagcacatgacagaggtggtgaggcggtgcccccaccatgagaggtgtagcgactctgatggcctggctccaccacagcatctgatccgcgtggagggcaacctgagggtggagtacctggacgatcgcaataccttcaggcactccgtggtggtgccctatgagcctccagaagtgggcagcgactgtaccacaatccattacaactatatgtgcaatagctcttgtatgggcggcatgaacagacgccctatcctgaccatcatcacactggaggattccagcggcaacctgctgggcaggaactcctttgaggtgagagtgtgcgcttgtcctggacgcgacaggagaaccgaggaggagaatctgaggaagaagggagagccacaccatgagctgccacctggcagcaccaagagggctctgcctaacaatacatcttccagcccccagcccaagaagaagccactggatggcgagtacttcacactgcagatcagaggccgcgagaggtttgagatgttcagggagctgaacgaggctctggagctgaaggacgcccaggctggcaaggagccaggaggctcccgggctcactcttcccatctgaagagcaagaagggccagtccaccagcagacacaagaagctgatgtttaagacagagggccccgattccgacgatgctcacaagagcgaggtggcccatcgctttaaggacctgggcgaggagaatttcaaggccctggtgctgatcgcctttgctcagtacctgcagcagtgccccttcgaggaccacgtgaagctggtgaacgaggtgaccgagtttgctaagacatgcgtggctgacgagtccgccgagaattgtgataagagcctgcataccctgttcggcgataagctgtgtaccgtggccacactgcgcgagacatatggcgagatggctgactgctgtgccaagcaggagccagagaggaacgagtgctttctgcagcataaggacgataaccctaatctgccaaggctggtgaggcccgaggtggacgtgatgtgtaccgcttttcacgataatgaggagacattcctgaagaagtacctgtatgagatcgccagacgccatccttacttctatgctccagagctgctgtttttcgccaagcggtacaaggccgcttttaccgagtgctgtcaggccgctgataaggccgcttgcctgctgcctaagctggacgagctgcgggatgagggcaaggctagctctgccaagcagagactgaagtgtgctagcctgcagaagtttggcgagagggccttcaaggcttgggctgtggctaggctgtctcagagatttccaaaggctgagttcgccgaggtgtccaagctggtgaccgacctgacaaaggtgcacaccgagtgctgtcatggcgacctgctggagtgcgccgacgatagggctgatctggccaagtacatctgtgagaaccaggacagcatctccagcaagctgaaggagtgctgtgagaagcctctgctggagaagtctcactgcatcgctgaggtggagaacgacgagatgccagccgatctgccctctctggccgctgacttcgtggagtccaaggatgtgtgtaagaattacgctgaggccaaggatgtgtttctgggcatgttcctgtacgagtatgctaggcggcaccctgactactctgtggtgctgctgctgcgcctggccaagacctatgagacaacactggagaagtgctgtgccgctgccgatccacatgagtgctatgctaaggtgtttgacgagttcaagcccctggtggaggagcctcagaacctgatcaagcagaattgtgagctgttcgagcagctgggcgagtacaagtttcagaacgccctgctggtgaggtataccaagaaggtgccacaggtgagcacccccacactggtggaggtgtctcggaatctgggcaaggtcggctccaagtgctgtaagcaccccgaggctaagagaatgccttgcgccgaggattacctgagcgtggtgctgaaccagctgtgtgtgctgcatgagaagacccccgtgtctgaccgggtgaccaagtgctgtacagagtctctggtgaacagacgcccctgcttctccgctctggaggtggatgagacatatgtgcctaaggagtttaatgctgagacattcaccttccacgccgacatctgtaccctgtctgagaaggagagacagatcaagaagcagacagccctggtggagctggtgaagcataagcctaaggctaccaaggagcagctgaaggccgtgatggacgattttgctgccttcgtggagaagtgctgtaaggctgacgataaggagacatgctttgccgaggagggaaagaaactggtcgccgcatctcaggccgctctgggactgcatcatcatcatcatcactgatagggatcc

SEQ ID NO: 162 - protein, 343 aa, Unknown
  Description of Unknown: Minimal Mouse/Rat/Human PTEN sequence
IVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKT

SEQ ID NO: 163 - protein, 323 aa, Homo sapiens
DKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQ

SEQ ID NO: 164 - protein, 13 aa, Artificial Sequence
  Description of Artificial Sequence: Synthetic peptide
TNRRKKRALDAAY

SEQ ID NO: 165 - protein, 8 aa, Artificial Sequence
  Description of Artificial Sequence: Synthetic peptide
GPAALKAA

SEQ ID NO: 166 - DNA, 1209 bp, Artificial Sequence
  Description of Artificial Sequence: Synthetic polynucleotide
atgaccgccatcatcaaggagatcgtgagcagaaacaagaggagataccaggaggacggcttcgacctggatctgacatacatctaccctaacatcatcgctatgggatttccagctgagcggctggagggcgtgtacaggaacaacatcgacgatgtggtgcggttcctggactccaagcacaagaaccactacaagatctacaacctgtgcgctgagaggcactacgacaccgccaagttcaactgtagagtggctcagtacccttttgaggatcacaaccctccacagctggagctgatcaagccattctgcgaggacctggatcagtggctgagcgaggacgataaccacgtggctgccatccactgcaaggccggaaagggccggacaggagtgatgatctgtgcttacctgctgcaccgcggcaagttcctgaaggctcaggaggccctggacttttacggagaggtgaggaccagagataagaagggcgtgacaatcccttcccagcggcgctacgtgtactactactcttacctgctgaagaaccacctggactaccgcccagtggccctgctgtttcacaagatgatgttcgagacaatcccaatgttctctggaggcacatgcaacccccagtttgtggtgtgccagctgaaggtgaagatctacagctccaacagcggaccaaccaggagagaggacaagttcatgtactttgagttcccacagcctctgcccgtgtgcggcgatatcaaggtggagtttttccacaagcagaacaagatgctgaagaaggacaagatgtttcacttctgggtcaacacctttttcatccccggacctgaggagacaagcgagaaggtggagaacggctccctgtgcgaccaggagatcgattctatctgtagcatcgagcgggccgacaacgataaggagtacctggtgctgaccctgacaaagaacgacctggataaggctaacaaggataaggccaaccgctacttttcccccaacttcaaggtgaagctgtacttcaccaagacagtggaggagccttctaacccagaggcctctagctccacctctgtgacaccagacgtgagcgataacgagcccgaccactacaggtacagcgataccacagactccgatcccgagaacgagccttttgacgaggatcagcacagccagatcaccaaggtg

SEQ ID NO: 167 - DNA, 1665 bp, Artificial Sequence
  Description of Artificial Sequence: Synthetic polynucleotide
tcagagtcaccagtcaccatcgctagggctggaaacgctggagagctgctgtcccctctgctgctgccccctacaaggagacggcgcaggagacacgtgcagggacctggaccagtgctgtccctgccatctgccgctgctgctccaccactggctagggctcctgaggccgctggcggaggctctcgctgcgaggactacccaagctccccacacagcgccgcttccgccgctcggccactggctgctgaggagaagcaggctcagagcctgcagccttctagctcccggcgctctagccactacccagctgctgtgcagggacaggctgctgctgagaggggagcttccgccaccgctaagtccagagccatctctatcctgcagaagaagccaaggcaccagcagctgctgccttccctgtcctctttctttttctctcacaggctgcctgatatgaccgccatcatcaaggagatcgtgagcagaaacaagaggagataccaggaggacggcttcgacctggatctgacatacatctaccctaacatcatcgctatgggatttccagctgagcggctggagggcgtgtacaggaacaacatcgacgatgtggtgcggttcctggactccaagcacaagaaccactacaagatctacaacctgtgcgctgagaggcactacgacaccgccaagttcaactgtagagtggctcagtacccttttgaggatcacaaccctccacagctggagctgatcaagccattctgcgaggacctggatcagtggctgagcgaggacgataaccacgtggctgccatccactgcaaggccggaaagggccggacaggagtgatgatctgtgcttacctgctgcaccgcggcaagttcctgaaggctcaggaggccctggacttttacggagaggtgaggaccagagataagaagggcgtgacaatcccttcccagcggcgctacgtgtactactactcttacctgctgaagaaccacctggactaccgcccagtggccctgctgtttcacaagatgatgttcgagacaatcccaatgttctctggaggcacatgcaacccccagtttgtggtgtgccagctgaaggtgaagatctacagctccaacagcggaccaaccaggagagaggacaagttcatgtactttgagttcccacagcctctgcccgtgtgcggcgatatcaaggtggagtttttccacaagcagaacaagatgctgaagaaggacaagatgtttcacttctgggtcaacacctttttcatccccggacctgaggagacaagcgagaaggtggagaacggctccctgtgcgaccaggagatcgattctatctgtagcatcgagcgggccgacaacgataaggagtacctggtgctgaccctgacaaagaacgacctggataaggctaacaaggataaggccaaccgctacttttcccccaacttcaaggtgaagctgtacttcaccaagacagtggaggagccttctaacccagaggcctctagctccacctctgtgacaccagacgtgagcgataacgagcccgaccactacaggtacagcgataccacagactccgatcccgagaacgagccttttgacgaggatcagcacagccagatcaccaaggtg

SEQ ID NO: 168 - DNA, 111 bp, Artificial Sequence
  Description of Artificial Sequence: Synthetic polynucleotide
ctgccacctacacggagaaggcgccggagacacatccagggaccaggacctgtgctgaacctgccaagcgccgccgccgccccacccgtggccagagccccagaggcagca

SEQ ID NO: 169 - DNA, 18 bp, Artificial Sequence
  Description of Artificial Sequence: Synthetic oligonucleotide
cggagaaggcgccggaga

SEQ ID NO: 170 - DNA, 48 bp, Artificial Sequence
  Description of Artificial Sequence: Synthetic oligonucleotide
ccacctacacggagaaggcgccggagacacatccagggaccaggacct

SEQ ID NO: 171 - DNA, 1728 bp, Artificial Sequence
  Description of Artificial Sequence: Synthetic polynucleotide
ctggagcgggggggagaagcggcggcggcggcggccgcggcggctgcagctccagggagggggagcgagagccctgtgaccatctccagggccggaaatgcaggagagctggtgtctcctctgctgctgccacctacacggagaaggcgccggagacacatccagggaccaggacctgtgctgaacctgccaagcgccgccgccgccccacccgtggccagagccccagaggcagcaggaggaggctccagatctgaggactatagctcctctccacacagcgccgccgccgccgcccggcccctggccgccgaggagaagcaggcccagtctctgcagcccagctcctctaggcgcagctcccactaccctgcagcagtgcagtcccaggctgccgccgagaggggagcctctgccaccgcaaagtctcgcgccatcagcatcctgcagaagaagccacgccaccagcagctgctgccctctctgtctagcttctttttcagccaccggctgcccgacatgaccgccatcatcaaggagatcgtgagcagaaataagcggcggtaccaggaggatggcttcgacctggatctgacatatatctaccccaacatcatcgccatgggatttcctgcagagcggctggagggcgtgtacagaaacaatatcgacgatgtggtgaggttcctggactccaagcacaagaaccactataagatctacaatctgtgcgccgagaggcactatgataccgccaagttcaactgtcgcgtggcccagtacccctttgaggaccacaatcctccacagctggagctgatcaagcctttctgcgaggacctggatcagtggctgtccgaggacgataatcacgtggcagcaatccactgcaaggcaggcaagggcaggacaggcgtgatgatctgtgcctatctgctgcaccgcggcaagttcctgaaggcccaggaggccctggacttttacggcgaggtgaggacccgcgataagaagggcgtgacaatcccaagccagcggcggtacgtgtactattactcctacctgctgaagaaccacctggactacaggccagtggccctgctgtttcacaagatgatgttcgagacaatccctatgttctccggcggcacatgcaacccacagtttgtggtgtgccagctgaaggtgaagatctattcctctaattctggcccaacccggagagaggataagttcatgtactttgagttcccacagccactgcccgtgtgcggcgacatcaaggtggagtttttccacaagcagaacaagatgctgaagaaggataagatgtttcacttctgggtgaatacctttttcatcccaggccccgaggagacatccgagaaggtggagaatggctctctgtgcgaccaggagatcgatagcatctgttccatcgagcgggccgacaacgataaggagtacctggtgctgaccctgacaaagaatgacctggataaggccaacaaggacaaggccaatagatacttcagccccaacttcaaggtgaagctgtacttcaccaagacagtggaggagccttccaatccagaggccagctcctctaccagcgtgacacctgacgtgtccgataacgagccagaccactatcggtactccgataccacagactctgatccagagaacgagccctttgacgaggatcagcacacccagatcacaaaggtg

SEQ ID NO: 172 - DNA, 1209 bp, Artificial Sequence
  Description of Artificial Sequence: Synthetic polynucleotide
atgaccgccatcatcaaggagatcgtgagcagaaataagcggcggtaccaggaggatggcttcgacctggatctgacatatatctaccccaacatcatcgccatgggatttcctgcagagcggctggagggcgtgtacagaaacaatatcgacgatgtggtgaggttcctggactccaagcacaagaaccactataagatctacaatctgtgcgccgagaggcactatgataccgccaagttcaactgtcgcgtggcccagtacccctttgaggaccacaatcctccacagctggagctgatcaagcctttctgcgaggacctggatcagtggctgtccgaggacgataatcacgtggcagcaatccactgcaaggcaggcaagggcaggacaggcgtgatgatctgtgcctatctgctgcaccgcggcaagttcctgaaggcccaggaggccctggacttttacggcgaggtgaggacccgcgataagaagggcgtgacaatcccaagccagcggcggtacgtgtactattactcctacctgctgaagaaccacctggactacaggccagtggccctgctgtttcacaagatgatgttcgagacaatccctatgttctccggcggcacatgcaacccacagtttgtggtgtgccagctgaaggtgaagatctattcctctaattctggcccaacccggagagaggataagttcatgtactttgagttcccacagccactgcccgtgtgcggcgacatcaaggtggagtttttccacaagcagaacaagatgctgaagaaggataagatgtttcacttctgggtgaatacctttttcatcccaggccccgaggagacatccgagaaggtggagaatggctctctgtgcgaccaggagatcgatagcatctgttccatcgagcgggccgacaacgataaggagtacctggtgctgaccctgacaaagaatgacctggataaggccaacaaggacaaggccaatagatacttcagccccaacttcaaggtgaagctgtacttcaccaagacagtggaggagccttccaatccagaggccagctcctctaccagcgtgacacctgacgtgtccgataacgagccagaccactatcggtactccgataccacagactctgatccagagaacgagccctttgacgaggatcagcacacccagatcacaaaggtg

SEQ ID NO: 173 - DNA, 4401 bp, Artificial Sequence
  Description of Artificial Sequence: Synthetic polynucleotide
gtacatttatattggctcatgtccaatatgaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagacggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaacggatctctagcgaattccctctagagggcccgtttctgctagcaagcttgctagcggccgctcgaggccggcaaggccggatcccccgacctcgacctctggctaataaaggaaatttattttcattgcaatagtgtgttggaattttttgtgtctctcactcggaaggacatatgggagggcaaatcatttggtcgagatccctcggagatctctagctagaggatcgatccccgccccggacgaactaaacctgactacgacatctctgccccttcttcgcggggcagtgcatgtaatcccttcagttggttggtacaacttgccaactgaaccctaaacgggtagcatatgcttcccgggtagtagtatatactatccagactaaccctaattcaatagcatatgttacccaacgggaagcatatgctatcgaattagggttagtaaaagggtcctaaggaacagcgatgtaggtgggcgggccaagataggggcgcgattgctgcgatctggaggacaaattacacacacttgcgcctgagcgccaagcacagggttgttggtcctcatattcacgaggtcgctgagagcacggtgggctaatgttgccatgggtagcatatactacccaaatatctggatagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctaatagagattagggtagtatatgctatcctaatttatatctgggtagcatatactacccaaatatctggatagcatatgctatcctaatctatatctgggtagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctcatgataagctgtcaaacatgagaattaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagc

SEQ ID NO: 174 - DNA, 7793 bp, Artificial Sequence
  Description of Artificial Sequence: Synthetic polynucleotide
agatctgcggccgcaccggtttaatttgaaaattgatattagcgtttaacagttaaattaatacgttaataatttttttgtctttaaatagggatttgaagcatattggtgttatagcgtacttagctggccagcatataagtattctataaaatactattacaaggaggaaatttacatgaaattatcgaagcgtggtttattctggctgttaggtttagtctcatttgcgatcttgttgttgttctctcagcccttgggtgctcaagcttcagagtctccagtgacgatttcgcgggcgggtaacgccggtgaattggttagcccgctattgctgccaccgacccgccgacggcgtcggcgtcatattcagggcccaggtccggttttgaacttgccttcagcggcagctgcgcctcccgtcgctcgggcacctgaagccgctgggggcggctcgcgctcagaggattatagtagtagtccccacagtgccgccgctgcggcccgccccctagccgccgaggaaaaacaagcacagtcattacagccttctagttcacgccgtagttctcattacccggcagctgtccaaagccaagcggcggccgagcgtggggcaagcgccactgccaagagccgtgcaatttcgattttacaaaagaaaccacgtcatcaacagttactgccgtcattatctagctttttctttagtcatcggctaccagatatgacagctattattaaagaaattgttagtcgaaataagcggcgctatcaagaagatggtttcgatttagatttaacatacatttatccaaatatcattgcgatgggatttcccgctgagcggttggaaggcgtctatcgaaacaatatcgacgatgttgtccggtttttagattcgaagcataagaatcactacaagatttacaacctgtgtgcagaacggcattatgacactgcgaagtttaattgtcgagttgcacaatatccgtttgaagatcataaccccccacaattagagttaatcaaaccattttgtgaagatttagatcagtggttaagtgaagatgataatcacgtggcggctattcattgtaaggctgggaagggtcgtacaggcgtgatgatttgcgcttacttattacaccgtggaaagtttctaaaagcgcaagaagcattagatttctatggtgaagttcgtacccgagataaaaagggcgtcacgatcccgagtcaacgccgctatgtttactactattcgtacttactaaagaatcacctagattatcgcccagtcgctttgttgttccataagatgatgtttgaaacgattccaatgttttctggtggcacgtgtaacccgcaatttgtagtgtgtcaactaaaagtgaagatatatagttcaaatagtgggcccactcgacgggaagataagttcatgtatttcgagtttccacagccattgccagtttgcggagacatcaaagtcgaatttttccacaagcaaaataagatgctgaaaaaagataaaatgtttcacttttgggtaaacactttctttattccaggaccagaagaaacctctgaaaaagtcgaaaatggttcgttatgcgatcaagaaattgattcgatttgtagtattgaacgtgcggacaatgacaaagaatatctggtattgactttgacgaaaaatgacttggacaaagccaataaagataaggcaaatcggtacttttcaccgaacttcaaggtcaaattatattttacgaaaactgtggaagaaccatcaaatccagaggcaagctcaagcaccagtgttacacctgacgtcagtgacaacgaacctgatcattatcggtatagcgacaccacggattcagatcctgaaaatgaaccgtttgacgaagatcaacatactcagatcacgaaagtttgatctagactcgaggaattcggtaccccgggttcgaaggcgccaagcttcaaattacagcacgtgttgctttgattgatagccaaaaagcagcagttgataaagcaattactgatattgctgaaaaattgtaatttataaataaaaatcaccttttagaggtggtttttttatttataaattattcgtttgatttcgctttcgatagaacaatcaaagcgagaataaggaagataaatcccataagggcgggagcagaatgtccgagactaattcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggaggcgcacgagggagcttccagggggaaacgcctggtatctttatagtcctgtcgggtttcgccacctctgacttgagcgtcgatttttgtgatgctcgtcaggggggcggagcctatcgaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgagaaggattattcggctggttgagacgttaaaatgataaaggttgtattaatcttatattacggttataatgtactcaacttaataaatgaacgcaaaaaaaagaaccctcaacttagcagagttaggattcacgacttatcagcacaacctgataagattttcgatagcaagtactaccaatacaagctatctaacttggtactattataacatgtaggctaagtttttcaaccattgatacttaaagtaaacggttgttatcgggaatcttaacagaaacctgatagcaaccgtttttttgttattcaatggttagcaaccatcaaagcaactaaaggctggaaacctgttcttagctagtaaaacctcccgtgagtgtcgttcgtgaccccgcttgcagttaacaacataggtatgctaaaccttgtcgagatcaacgcgactaaagacgtggctggaagactaggaaatgatacggacaggctaactattaacgcagattattcgggttgctgctaaaaccaactctaataatagttagtgcaagggctggttgagcttaaattgtctgataaagagttctctctttatactgcaaaagaagcgcagttattcacgattaggataactgtttgagagagcctaagggcttgacccttgatggtttaagcaccgctatgcgtgcgggatccccttagaagcaaacttaagagtgtgttgatagtgcattatcttaaaattttgtataataggaattgaagttaaattagatgctaaaaataggaattgaagttaaattagatgctaaaaatttgtaattaagaaggagggattcgtcatgttggtattccaaatgcgtaatgtagataaaacatctactgttttgaaacagactaaaaacagtgattacgcagataaataaatacgttagattaattcctaccagtgactaatcttatgactttttaaacagataactaaaattacaaacaaatcgtttaacttcaggagagattacatggttgtaattggggagcaccgccacacacaagtcacagtcgacttgcaggcaattaagacaaatattagtaatgaaatggcgcaaaaggatgagttgaccgagttatgggcagtcgttaaagcgaatggttatggacatggaattatccaagttgctcaggccgccaaagaagccggggcgaccggcttttgtgttgcaatcctggatgaggccttagcgttgcgggccgctggctttgcggaacccatcctagtacttggaattacggaaccggaatacgccccactggtagctgaaaaggatatttcactagctgttggaacgcaagattggctgactacggccgcagcaattttagcggctaatcaagtgacgacaccacttcacgttcatcttgcattagatacgggtatgggacgaatcgggtttcagacgcccgaagaattggcaacggcggttacgactttgcgtcaaccgcagtcaccatttgactttgaagggatttttacgcattttgcaacggctgaccaggcagatgatacgtattttactcatcaattaaataattggaaacacttgattgcagtggtggatgagctaccacgctatgtccacgtgtccaattcggccaccagtctctggcatcaagcttgcaatggcaacatggtgcgctttggggttgcactctatggtctaaatccttctggtcgcgaactcagcgcaccataccccttgcaacccgcgttgtcgctaacggcacgcttgacgtttgttaaacgcttggctcggggcaaatcggtcagctatggtgccacgtatacggccgcacaggatgaatggattggcacggtgccgattgggtatgcggacggctatgaacgccgattacaaggcttccatgtacttgttgatggtgagttttgcgaaatcgtcggacgggtctgcatggaccagctgatggttcgtctgccacatgaagtaccggttggagctaaggtaactttggttggcacggacggtgctcgtaccatttcgttgcaagatattgctgactattgtgggacaattcattatgagattgcttgtgggttagcaccacgagtgccgagagtttatatagattaattctatgagtcgcttttttaaatttggaaagttacacgttactaaagggaatggagaccggggcccttcaatagagttcttaacgttaatccgaaaaaaactaacgttaatattaaaaaataagatccgcttgtgaattatgtataatttgattagactaaagaataggagaaagtatgatgatatttaaaaaactttctcgttaagataggttgttggtgagcatgttatatacggatgtatcggtttccttaatgcaaaattttgttgctatcttattaatttttctattatatagatatattcaaagaaagataacatttaaacggatcatattagatattttaatagcgattattttttcaatattatatctgtttatttcagatgcgtcattacttgtaatggtattaatgcgattagggtggcattttcatcaacaaaaagaaaataagataaaaacgactgatacagctaatttaattctaattatcgtgatccagttattgttagttgcggttgggactattattagtcagtttaccatatcgattatcaaaagtgatttcagccaaaatatattgaacaatagtgcaacagatataactttattaggtattttctttgctgttttatttgacggcttgttctttatattattgaagaataagcggactgaattacaacatttaaatcaagaaatcattgaattttcgttagaaaaacaatattttatatttatatttattttatttatagtaatagaaattattttagcagttgggaatcttcaaggagtaacagccacgatattattaaccattatcattattttttgtgtccttatcgggatgactttttggcaagtgatgctttttttgaaggcttattcgattcgccaagaagccaatgaccaattggtccggaatcaacaacttcaagattatctagtcaatatcgaacagcagtacaccgaattacggcgatttaagcatgattatcaaaacatcttattatcgttggagagttttgccgaaaagggcgatcagcaacagtttaaggcgtattaccaagaattattagcacaacggccaattcaaagtgaaatccaaggggcagtcattgcacaactcgactacttgaaaaatgatcctattcgaggattagtcattcaaaagtttttggcagccaaacaggctggtgttactttaaaattcgaaatgaccgaaccaatcgaattagcaaccgctaatctattaacggttattcggattatcggtattttattagacaatgcgattgaacaagccgttcaagaaaccgatcaattggtgagttgtgctttcttacaatctgatggtttaatcgaaattacgattgaaaatacggccagtcaagttaagaatctccaagcattttcagagttaggctattcaacgaaaggcgctggtcgggggactggtttagctaatgtgcaggatttgattgccaaacaaaccaatttattcttagaaacacagattgaaaatagaaagttacgacagacattgatgattacggaggaaacttaatttgtatcccgtttatttattagaggatgatttacagcaacaagcgatttatcagcaaattatcgcgaatacgattatgattaacgaatttgcaatgactttaacatgcgctgccagtgatactgagacattgttggcggcaattaaggatcagcaacgaggtttattctttttggatatggaaattgaggataaccgccaagccggtttagaagtggcaactaagattcggcagatgatgccgtttgcgcaaattgtcttcattacaacccacgaggaactgacattattaacgttagaacgaaaaatagcgcctttagattacattctcaaggaccaaacaatggctgaaatcaaaaggcaattgattgatgatctattgttagctgagaagcaaaacgaggcggcagcgtatcaccgagaaaatttatttagttataaaataggtcctcgctttttctcattaccattaaaggaagttgtttatttatatactgaaaaagaaaatccgggtcatattaatttgttagccgttaccagaaaggttacttttccaggaaatttaaatgcgctggaagcccaatatccaatgctctttcggtgtgataaaagttacttagttaacctatctaatattgccaattatgacagtaaaacacggagtttaaaatttgtagatggcagtgaggcaaaagtctcgttccggaaatcacgggaactagtggccaaattaaaacaaatgatgtagcgcctgcaggcacgccaaatgatcccagtaaaaagccacccgcatggcgggtggctttttattagccctagaagggcttcccacacgcatttcagcgccttagtgccttagtttgtgaatcataggtggtatagtcccgaaatacccgtctaaggaattgtcagataggcctaatgactggcttttataatatgagataatgccgactgtactttttacagtcggttttctaatgtcactaacctgccccgttagttgaagaaggtttttatattacagctcc

SEQ ID NO: 175 - DNA, 5391 bp, Artificial Sequence
  Description of Artificial Sequence: Synthetic polynucleotide
aacatccaaagacgaaaggttgaatgaaacctttttgccatccgacatccacaggtccattctcacacataagtgccaaacgcaacaggaggggatacactagcagcagaccgttgcaaacgcaggacctccactcctcttctcctcaacacccacttttgccatcgaaaaaccagcccagttattgggcttgattggagctcgctcattccaattccttctattaggctactaacaccatgactttattagcctgtctatcctggcccccctggcgaggttcatgtttgtttatttccgaatgcaacaagctccgcattacacccgaacatcactccagatgagggctttctgagtgtggggtcaaatagtttcatgttccccaaatggcccaaaactgacagtttaaacgctgtcttggaacctaatatgacaaaagcgtgatctcatccaagatgaactaagtttggttcgttgaaatgctaacggccagttggtcaaaaagaaacttccaaaagtcggcataccgtttgtcttgtttggtattgattgacgaatgctcaaaaataatctcattaatgcttagcgcagtctctctatcgcttctgaaccccggtgcacctgtgccgaaacgcaaatggggaaacacccgctttttggatgattatgcattgtctccacattgtatgcttccaagattctggtgggaatactgctgatagcctaacgttcatgatcaaaatttaactgttctaacccctacttgacagcaatatataaacagaaggaagctgccctgtcttaaacctttttttttatcatcattattagcttactttcataattgcgactggttccaattgacaagcttttgattttaacgacttttaacgacaacttgagaagatcaaaaaacaactaattattgaaagaattcaaaacgatgagatttccttcaatttttactgctgttttattcgcagcatcctccgcattagctgctccagtcaacactacaacagaagatgaattagaaggggatttcgatgttgctgttttgccattttccgccagcattgctgctaaagaagaaggggtatctctcgagaaaagaatgtctgagtcgccagtgactatctccagagccggaaatgccggtgaattagtttccccactgttgttgccgcccactcgtagacgtaggcgtagacatatccagggaccaggaccagtgctgaatttaccttcagctgctgctgctccgccggtagctagggccccagaagcggcaggaggtggttctaggtccgaggattactctagctctccacattcggctgctgccgccgcaagacctttagcagcagaagagaagcaagcacaatctttgcaaccttcctcctctagaagatcaagccattatcctgctgctgtccagagtcaggcagctgctgagaggggtgcctctgctactgccaaatctagagctatatctatcttgcagaaaaagcctagacaccaacaactccttccatccctgtcgagtttcttcttctctcacaggctcccagatatgactgccattatcaaggagatcgtcagtcgtaacaagagaagataccaagaggacggcttcgacctggatcttacatatatttacccaaacatcatagctatggggttccccgcagaaagattggaaggtgtctatagaaataatattgacgacgttgttagatttctagatagcaaacataaaaatcactacaagatatacaacctctgtgctgaaagacactacgacactgctaagttcaattgtagagtagcacagtaccccttcgaggatcataatcctccacaacttgagttgatcaaacctttttgtgaggacttggaccaatggctgtcagaggacgataatcacgtcgcagctattcattgtaaggctggaaaaggtcgaacaggagtcatgatttgtgcttatctactgcacagaggtaagtttctaaaagctcaagaggctttggatttttatggtgaagttaggactagagacaaaaagggtgttaccatccccagccagagaaggtacgtatattattacagttatctgttgaaaaaccacttagactaccgtcccgttgcactgttattccacaagatgatgtttgaaacgatcccaatgttctctggtggaacttgtaaccctcaattcgttgtttgccagttaaaggttaaaatttatagctccaattcaggacccacaagacgggaagataaatttatgtactttgaatttccacaaccattgccagtctgtggtgatattaaggtagagtttttccataagcaaaacaaaatgttgaaaaaagacaaaatgttccacttctgggtgaataccttcttcattcctggaccagaggaaacgtccgaaaaagttgaaaacggctcattgtgtgatcaagagattgactccatctgttcaatcgagcgtgcagacaatgataaagagtacttggtgcttacattgaccaaaaatgatctggataaggctaacaaagacaaagccaatagatatttctcaccaaattttaaagttaagttgtatttcaccaagactgttgaggagccttccaatccagaagcatccagcagtacttcagttactccagacgtatctgacaatgagcctgaccattatcgttactctgatactactgactccgatcctgaaaacgaaccatttgatgaggaccagcacacccaaattacaaaagtttagggttaaggggcggccgctcaagaggatgtcagaatgccatttgcctgagagatgcaggcttcatttttgatacttttttatttgtaacctatatagtataggattttttttgtcattttgtttcttctcgtacgagcttgctcctgatcagcctatctcgcagcagatgaatatcttgtggtaggggtttgggaaaatcattcgagtttgatgtttttcttggtatttcccactcctcttcagagtacagaagattaagtgaaaccttcgtttgtgcggatccttcagtaatgtcttgtttcttttgttgcagtggtgagccattttgacttcgtgaaagtttctttagaatagttgtttccagaggccaaacattccacccgtagtaaagtgcaagcgtaggaagaccaagactggcataaatcaggtataagtgtcgagcactggcaggtgatcttctgaaagtttctactagcagataagatccagtagtcatgcatatggcaacaatgtaccgtgtggatctaagaacgcgtcctactaaccttcgcattcgttggtccagtttgttgttatcgatcaacgtgacaaggttgtcgattccgcgtaagcatgcatacccaaggacgcctgttgcaattccaagtgagccagttccaacaatctttgtaatattagagcacttcattgtgttgcgcttgaaagtaaaatgcgaacaaattaagagataatctcgaaaccgcgacttcaaacgccaatatgatgtgcggcacacaataagcgttcatatccgctgggtgactttctcgctttaaaaaattatccgaaaaaattttctagagtgttgttactttatacttccggctcgtataatacgacaaggtgtaaggaggactaaaccatggctaaactcacctctgctgttccagtcctgactgctcgtgatgttgctggtgctgttgagttctggactgatagactcggtttctcccgtgacttcgtagaggacgactttgccggtgttgtacgtgacgacgttaccctgttcatctccgcagttcaggaccaggttgtgccagacaacactctggcatgggtatgggttcgtggtctggacgaactgtacgctgagtggtctgaggtcgtgtctaccaacttccgtgatgcatctggtccagctatgaccgagatcggtgaacagccctggggtcgtgagtttgcactgcgtgatccagctggtaactgcgtgcatttcgtcgcagaagaacaggactaacaattgacaccttacgattatttagagagtatttattagttttattgtatgtatacggatgttttattatctatttatgcccttatattctgtaactatccaaaagtcctatcttatcaagccagcaatctatgtccgcgaacgtcaactaaaaataagctttttatgctgttctctctttttttcccttcggtataattataccttgcatccacagattctcctgccaaattttgcataatcctttacaacatggctatatgggagcacttagcgccctccaaaacccatattgcctacgcatgtataggtgttttttccacaatattttctctgtgctctctttttattaaagagaagctctatatcggagaagcttctgtggccgttatattcggccttatcgtgggaccacattgcctgaattggtttgccccggaagattggggaaacttggatctgattaccttagctgcaggtaccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcggtacccagatccaattcccgctttgactgcctgaaatctccatcgcctacaatgatgacatttggatttggttgactcatgttggtattgtgaaatagacgcagatcgggaacactgaaaaatacacagttattattcatttaaat

SEQ ID NO: 176 - DNA, 1755 bp, Artificial Sequence
  Description of Artificial Sequence: Synthetic polynucleotide
gatgcccacaagagcgaggtggcccaccgctttaaggacctgggcgaggagaacttcaaggccctggtgctgatcgcctttgcccagtacctgcagcagtgcccattcgaggatcacgtgaagctggtgaatgaggtgaccgagtttgccaagacatgcgtggccgacgagagcgccgagaactgtgataagtccctgcacaccctgttcggcgacaagctgtgcaccgtggccacactgcgggagacatatggcgagatggccgattgctgtgccaaacaggagcctgagagaaatgagtgctttctgcagcacaaggacgataacccaaatctgcctaggctggtgcggcccgaggtggacgtgatgtgcaccgcctttcacgataacgaggagacattcctgaagaagtatctgtacgagatcgcccggagacacccctatttctacgcccctgagctgctgtttttcgccaagagatacaaggccgcctttaccgagtgctgtcaggcagcagacaaggcagcatgcctgctgccaaagctggacgagctgagggatgagggcaaggccagctccgccaagcagagactgaagtgtgccagcctgcagaagtttggagagagggccttcaaggcctgggcagtggcaaggctgagccagcggttcccaaaggcagagttcgcagaggtgtccaagctggtgaccgatctgacaaaggtgcacaccgagtgctgtcacggcgacctgctggagtgcgcagacgatagggcagatctggccaagtacatctgtgagaaccaggactctatctctagcaagctgaaggagtgctgtgagaagcccctgctggagaagagccactgcatcgccgaggtggagaatgacgagatgcctgccgatctgccatctctggccgccgacttcgtggagagcaaggacgtgtgcaagaactatgccgaggccaaggacgtgtttctgggcatgttcctgtatgagtacgccaggcgccaccccgattattccgtggtgctgctgctgcggctggccaagacctacgagacaaccctggagaagtgctgtgccgccgccgacccccacgagtgctacgcaaaggtgtttgacgagttcaagccactggtggaggagccccagaacctgatcaagcagaattgtgagctgttcgagcagctgggcgagtataagtttcagaatgccctgctggtgagatacacaaagaaggtgcctcaggtgtccaccccaacactggtggaggtgtctaggaacctgggcaaggtcggcagcaagtgctgtaagcacccagaggcaaagaggatgccttgcgccgaggactatctgtctgtggtgctgaaccagctgtgcgtgctgcacgagaagacccccgtgagcgatcgggtgaccaagtgctgtacagagtctctggtgaatagacggccctgcttcagcgccctggaggtggacgagacatacgtgccaaaggagtttaacgccgagacattcaccttccacgccgacatctgtaccctgtccgagaaggagagacagatcaagaagcagacagccctggtggagctggtgaagcacaagcctaaggccaccaaggagcagctgaaggccgtgatggacgattttgccgccttcgtggagaagtgctgtaaggccgacgataaggagacatgcttcgccgaggagggcaagaagctggtcgccgcttcacaggctgctctggggctg

SEQ ID NO: 177 - DNA, 1752 bp, Artificial Sequence
  Description of Artificial Sequence: Synthetic polynucleotide
gatacccacaagagcgaggtggcccaccgctttaaggacctgggcgaggagcacttcaagggcctggtgctggtggccttttcccagtatctgcagcagtgccctttcgaggagcacgtgaagctggtgaatgaggtgaccgagtttgccaagacatgcgtggccgacgagagcgccgagaactgtgataagtccctgcacaccctgttcggcgacaagctgtgcaccgtggccacactgcgggagacatacggcgagatggccgattgctgtgccaagcaggagccagagagaaatgagtgctttctgcagcacaaggacgataacccaaatctgccacctctggtgcggcccgaggtggacgtgatgtgcaccgcctttcacgataacgaggccacattcctgaagaagtatctgtacgaggtggccaggcgccacccctatttctacgcccctgagctgctgtttttcgccgccagatataaggcagcctttgccgagtgctgtcaggcagcagacaaggcagcatgcctgctgccaaagctggacgagctgagggatgagggcaaggccagctccgccaagcagagactgaagtgtgcctccctgcagaagtttggcgacagggccttcaaggcctgggcagtggcaaggctgagccagaagtttcccaaggccgagttcgccgaggtgtccaagctggtgaccgatctgacaaaggtgcacaccgagtgctgtcacggcgacctgctggagtgcgcagacgatagggcagatctggccaagtacatgtgcgagaaccaggactctatctctagcaagctgaaggagtgctgtgataagcccctgctggagaagagccactgcctggccgaggtggagaatgacgagatgcctgccgatctgccatctctggccgccgactatgtggagagcaaggacgtgtgcaagaactacgccgaggccaaggacgtgtttctgggcatgttcctgtatgagtacgcccggagacaccccgattatagcgtgatgctgctgctgagactggccaaggcctacgaggccaccctggagaagtgctgtgcagcagccgatcctcacgagtgctacgcaaaggtgtttgacgagttccagccactggtggaggagccccagaacctggtgaagcagaattgtgagctgttcgagcagctgggcgagtataagtttcagaatgccctgctggtgaggtacaccaagaaggtgcctcaggtgtccaccccaacactggtggaggtgtctcgcaacctgggcaaggtcggcgccaagtgctgtaagctgcccgaggccaagaggatgccttgcgccgaggactatctgtctgtggtgctgaatcgcctgtgcgtgctgcacgagaagacacccgtgagcgagaaggtgaccaagtgctgtacagagtctctggtgaataggcgcccctgcttcagcgccctggagctggacgaggcctacgtgcctaaggcctttaacgccgagacattcaccttccacgccgatatgtgcaccctgagcgagaaggagaagcaggtgaagaagcagacagccctggtggagctggtgaagcacaagcctaaggccaccaaggagcagctgaagggcgtgatggataactttgccgccttcgtggagaagtgctgtaaggccgacgataaggaggcctgcttcgccgaggagggacccaagtttgtcgccgcatcacaggcagcactggca

SEQ ID NO: 178 - DNA, 1752 bp, Artificial Sequence
  Description of Artificial Sequence: Synthetic polynucleotide
gaggctcacaagtccgagatcgcccacaggttcaaggacctgggagagcagcacttcaagggcctggtgctgatcgccttttctcagtacctgcagaagtgcccctacgaggagcacatcaagctggtgcaggaggtgaccgatttcgctaagacatgcgtggctgacgagaacgccgagaactgtgataagagcatccacacactgtttggagacaagctgtgcgccatccccaagctgagggacaactacggcgagctggctgattgctgtgccaagcaggagcctgagagaaacgagtgcttcctgcagcacaaggacgataaccccaacctgccaccttttcagcggcctgaggctgaggctatgtgcacctcttttcaggagaaccctacaagcttcctgggacactacctgcacgaggtggctcggcgccacccttacttctacgctccagagctgctgtactacgctgagaagtacaacgaggtgctgacccagtgctgtacagagagcgacaaggctgcctgcctgacccccaagctggatgctgtgaaggagaaggccctggtggctgccgtgcggcagcgcatgaagtgttctagcatgcagaggtttggagagagagccttcaaggcttgggctgtggctaggatgtcccagaggttccctaacgctgagttcgccgagatcaccaagctggccaccgacgtgacaaagatcaacaaggagtgctgtcacggcgatctgctggagtgcgctgacgatagagctgagctggccaagtacatgtgcgagaaccaggccacaatctcctctaagctgcaggcttgctgtgacaagccagtgctgcagaagagccagtgcctggccgagatcgagcacgacaacatcccagctgatctgccctccatcgctgccgacttcgtggaggataaggaggtgtgcaagaactacgctgaggccaaggacgtgttcctgggcaccttcctgtacgagtacagcaggagacaccccgactatagcgtgtccctgctgctgaggctggctaagaagtacgaggccaccctggagaagtgctgtgctgagggcgaccccccagcttgctacggaacagtgctggctgagttccagccactggtggaggagcctaagaacctggtgaagaccaactgtgagctgtacgagaagctgggagagtacggctttcagaacgccgtgctggtgagatacacacagaaggctccacaggtgtccacccccacactggtggaggctgccaggaacctgggaagagtgggcaccaagtgctgtacactgcctgaggctcagcggctgccatgcgtggaggattacctgtctgctatcctgaaccgcctgtgcgtgctgcacgagaagacccccgtgagcgagaaggtgacaaagtgctgttctggaagcctggtggagcggcgcccatgcttctccgccctgaccgtggacgagacatacgtgcccaaggagtttaaggctgagacattcaccttccactctgacatctgtaccctgccagataaggagaagcagatcaagaagcagacagctctggccgagctggtgaagcacaagcccaaggccaccgaggaccagctgaagacagtgatgggcgactttgctcagttcgtggataagtgctgtaaggctgccgacaaggataactgtttcgccaccgaaggtccaaatctcgtcgcccgctccaaagaagcactggct

SEQ ID NO: 179 - DNA, 1752 bp, Artificial Sequence
  Description of Artificial Sequence: Synthetic polynucleotide
gaggctcacaaaagcgagattgcccatagatacaacgacctgggggaacagcatttcaagggactggtcctgattgcattttcacagtacctgcagaagtgcagctatgacgagcacgccaagctggtgcaggaggtgaccgatttcgccaagacatgcgtggcagacgagtccgccgcaaactgtgataagtctctgcacaccctgtttggcgacaagctgtgcgccatccccaacctgcgggagaattatggcgagctggccgattgctgtacaaagcaggagcctgagcgcaacgagtgcttcctgcagcacaaggacgataatccaagcctgccaccttttgagcggcccgaggcagaggcaatgtgcacctccttcaaggagaacccaaccaccttcatgggccactacctgcacgaggtggccaggagacacccctacttctatgcccctgagctgctgtactatgccgagcagtataatgagatcctgacccagtgctgtgccgaggccgacaaggagagctgcctgacacctaagctggatggcgtgaaggagaaggccctggtgagctccgtgcggcagcgcatgaagtgttctagcatgcagaagttcggcgagagggcctttaaggcatgggcagtggcaaggctgtcccagaccttcccaaacgccgactttgccgagatcacaaagctggccaccgatctgacaaaagtgaataaggagtgctgtcacggcgacctgctggagtgcgcagacgatagggcagagctggccaagtatatgtgcgagaaccaggccaccatctcctctaagctgcagacatgctgtgataagcccctgctgaagaaggcccactgcctgtctgaggtggagcacgacaccatgcctgcagatctgccagcaatcgcagcagacttcgtggaggatcaggaggtgtgcaagaactacgccgaggccaaggacgtgttcctgggcacctttctgtacgagtattcccggcgccaccctgattacagcgtgtccctgctgctgaggctggccaagaagtatgaggccaccctggagaagtgctgtgcagaggcaaatccaccagcatgctacggaacagtgctggcagagttccagccactggtggaggagcccaagaacctggtgaagaccaattgtgacctgtacgagaagctgggcgagtatggctttcagaacgccatcctggtgagatatacacagaaggcccctcaggtgtccaccccaacactggtggaggccgccaggaatctgggcagagtgggcaccaagtgctgtacactgcccgaggaccagaggctgccttgcgtggaggattacctgtctgccatcctgaatagggtgtgcctgctgcacgagaagacccctgtgagcgagcacgtgacaaagtgctgttctggcagcctggtggagaggaggccctgcttctccgccctgaccgtggacgagacatacgtgccaaaggagtttaaggccgagactttcacgtttcactctgatatctgtaccctgccagagaaggagaagcagatcaagaagcagacagccctggccgagctggtgaagcacaagcccaaggccaccgccgagcagctgaagacagtgatggacgatttcgcccagtttctggacacctgctgtaaggccgccgataaggacacctgtttctccactgaggggcctaatctggtcacacgctgtaaagacgcactggca

SEQ ID NO: 180 - DNA, 72 bp, Artificial Sequence
  Description of Artificial Sequence: Synthetic oligonucleotide
atgaagtgggtgacctttattagcctgctgttcctgtttagttccgcatactcaagaggggtgtttagaaga

SEQ ID NO: 181 - DNA, 72 bp, Artificial Sequence; identical to SEQ ID NO: 180
  Description of Artificial Sequence: Synthetic oligonucleotide

SEQ ID NO: 182 - DNA, 72 bp, Artificial Sequence
  Description of Artificial Sequence: Synthetic oligonucleotide
atgaaatgggtcaccttcctcctcctgctgttcatctctggttccgcctttagccggggggtcttccgacgg

SEQ ID NO: 183 - DNA, 72 bp, Artificial Sequence
  Description of Artificial Sequence: Synthetic oligonucleotide
atgaaatgggtcaccttcctcctcctgctgttcgtgtctggttccgcctttagccggggggtcttccgacgg

SEQ ID NO: 184 - DNA, 66 bp, Artificial Sequence
  Description of Artificial Sequence: Synthetic oligonucleotide
atgaggagaaaccagctgcccacccctgccttcctgctgctgtttctgctgctgccaagggacgct

SEQ ID NO: 185 - DNA, 57 bp, Artificial Sequence
  Description of Artificial Sequence: Synthetic oligonucleotide
atgctgtctctgagggtgacctgcctgatcctgagcgtggcctccaccgtgtggaca

SEQ ID NO: 186 - DNA, 72 bp, Artificial Sequence
  Description of Artificial Sequence: Synthetic oligonucleotide
atgaccccaagcatctcctggggactgctgctgctggctggactgtgctgtctggtgccttctttcctggct

SEQ ID NO: 187 - DNA, 60 bp, Artificial Sequence
  Description of Artificial Sequence: Synthetic oligonucleotide
atggagaccgacacactgctgctgtgggtgctgctgctgtgggtgccaggcagcaccgga

SEQ ID NO: 188 - DNA, 57 bp, Artificial Sequence
  Description of Artificial Sequence: Synthetic oligonucleotide
atggagtttgggctgtcatgggtgttcctggtcgcaatcctgaaaggcgtgcagtgt

SEQ ID NO: 189 - DNA, 60 bp, Artificial Sequence
  Description of Artificial Sequence: Synthetic oligonucleotide
atggtgctgcagacccaggtgttcatcagcctgctgctgtggatctccggcgcctacgga

SEQ ID NO: 190 - DNA, 48 bp, Artificial Sequence
  Description of Artificial Sequence: Synthetic oligonucleotide
atgcccctgctgctgctgctgcctctgctgtgggccggcgctctggcc

SEQ ID NO: 191 - DNA, 63 bp, Artificial Sequence
  Description of Artificial Sequence: Synthetic oligonucleotide
atgtggtggaggctgtggtggctcctcctgctgctgctgctgctgtggcccatggtgtgggcc

SEQ ID NO: 192 - DNA, 69 bp, Artificial Sequence
  Description of Artificial Sequence: Synthetic oligonucleotide
atgtggtggaggctgtggtggctcctcctgctgctgctgctgctgtggcccatggtgtgggccgctgcc

SEQ ID NO: 193 - DNA, 456 bp, Artificial Sequence
  Description of Artificial Sequence: Synthetic polynucleotide
agcgagagccctgtgaccatctccagggccggaaatgcaggagagctggtgtctcctctgctgctgccacctacacggagaaggcgccggagacacatccagggaccaggacctgtgctgaacctgccaagcgccgccgccgccccacccgtggccagagccccagaggcagcaggaggaggctccagatctgaggactatagctcctctccacacagcgccgccgccgccgcccggcccctggccgccgaggagaagcaggcccagtctctgcagcccagctcctctaggcgcagctcccactaccctgcagcagtgcagtcccaggctgccgccgagaggggagcctctgccaccgcaaagtctcgcgccatcagcatcctgcagaagaagccacgccaccagcagctgctgccctctctgtctagcttctttttcagccaccggctgcccgac

SEQ ID NO: 194 - DNA, 438 bp, Artificial Sequence
  Description of Artificial Sequence: Synthetic polynucleotide
atctccagggccggaaatgcaggagagctggtgtctcctctgctgctgccacctacacggagaaggcgccggagacacatccagggaccaggacctgtgctgaacctgccaagcgccgccgccgccccacccgtggccagagccccagaggcagcaggaggaggctccagatctgaggactatagctcctctccacacagcgccgccgccgccgcccggcccctggccgccgaggagaagcaggcccagtctctgcagcccagctcctctaggcgcagctcccactaccctgcagcagtgcagtcccaggctgccgccgagaggggagcctctgccaccgcaaagtctcgcgccatcagcatcctgcagaagaagccacgccaccagcagctgctgccctctctgtctagcttctttttcagccaccggctgcccgac

SEQ ID NO: 195 - DNA, 393 bp, Artificial Sequence
  Description of Artificial Sequence: Synthetic polynucleotide
ctgccacctacacggagaaggcgccggagacacatccagggaccaggacctgtgctgaacctgccaagcgccgccgccgccccacccgtggccagagccccagaggcagcaggaggaggctccagatctgaggactatagctcctctccacacagcgccgccgccgccgcccggcccctggccgccgaggagaagcaggcccagtctctgcagcccagctcctctaggcgcagctcccactaccctgcagcagtgcagtcccaggctgccgccgagaggggagcctctgccaccgcaaagtctcgcgccatcagcatcctgcagaagaagccacgccaccagcagctgctgccctctctgtctagcttctttttcagccaccggctgcccgac

SEQ ID NO: 196 - DNA, 216 bp, Artificial Sequence
  Description of Artificial Sequence: Synthetic polynucleotide
ctggccgccgaggagaagcaggcccagtctctgcagcccagctcctctaggcgcagctcccactaccctgcagcagtgcagtcccaggctgccgccgagaggggagcctctgccaccgcaaagtctcgcgccatcagcatcctgcagaagaagccacgccaccagcagctgctgccctctctgtctagcttctttttcagccaccggctgcccgac

SEQ ID NO: 197 - DNA, 1029 bp, Artificial Sequence
  Description of Artificial Sequence: Synthetic polynucleotide
atcgtgagccgcaataagaggcgctatcaggaggatggcttcgacctggatctgacatatatctacccaaacatcatcgccatgggatttccagcagagaggctggagggcgtgtacaggaacaatatcgacgatgtggtgaggttcctggactccaagcacaagaaccactataagatctacaatctgtgcgccgagcggcactatgataccgccaagttcaactgtagagtggcccagtacccatttgaggaccacaatccaccccagctggagctgatcaagcccttttgcgaggacctggatcagtggctgagcgaggacgataatcacgtggcagcaatccactgcaaggcaggcaagggaaggacaggcgtgatgatctgtgcctatctgctgcacaggggcaagttcctgaaggcccaggaggccctggacttttacggcgaggtgcggaccagagataagaagggcgtgacaatccctagccagcggcggtacgtgtactattactcctacctgctgaagaaccacctggactaccgcccagtggccctgctgtttcacaagatgatgttcgagacaatccctatgttctccggcggcacatgcaacccacagtttgtggtgtgccagctgaaggtgaagatctatagctccaattctggccccaccaggcgcgaggataagttcatgtactttgagttcccccagcctctgccagtgtgcggcgacatcaaggtggagtttttccacaagcagaacaagatgctgaagaaggataagatgtttcacttctgggtgaatacctttttcatccccggccctgaggagacaagcgagaaggtggagaatggctccctgtgcgaccaggagatcgattctatctgtagcatcgagagggccgacaacgataaggagtacctggtgctgaccctgacaaagaatgacctggataaggccaacaaggacaaggccaatcgctatttttctcccaacttcaaggtgaagctgtacttcaccaagaca

SEQ ID NO: 198 - DNA, 1647 bp, Artificial Sequence
  Description of Artificial Sequence: Synthetic polynucleotide
atctccagggccggaaatgcaggagagctggtgtctcctctgctgctgccacctacacggagaaggcgccggagacacatccagggaccaggacctgtgctgaacctgccaagcgccgccgccgccccacccgtggccagagccccagaggcagcaggaggaggctccagatctgaggactatagctcctctccacacagcgccgccgccgccgcccggcccctggccgccgaggagaagcaggcccagtctctgcagcccagctcctctaggcgcagctcccactaccctgcagcagtgcagtcccaggctgccgccgagaggggagcctctgccaccgcaaagtctcgcgccatcagcatcctgcagaagaagccacgccaccagcagctgctgccctctctgtctagcttctttttcagccaccggctgcccgacatgaccgccatcatcaaggagatcgtgagcagaaataagcggcggtaccaggaggatggcttcgacctggatctgacatatatctaccccaacatcatcgccatgggatttcctgcagagcggctggagggcgtgtacagaaacaatatcgacgatgtggtgaggttcctggactccaagcacaagaaccactataagatctacaatctgtgcgccgagaggcactatgataccgccaagttcaactgtcgcgtggcccagtacccctttgaggaccacaatcctccacagctggagctgatcaagcctttctgcgaggacctggatcagtggctgtccgaggacgataatcacgtggcagcaatccactgcaaggcaggcaagggcaggacaggcgtgatgatctgtgcctatctgctgcaccgcggcaagttcctgaaggcccaggaggccctggacttttacggcgaggtgaggacccgcgataagaagggcgtgacaatcccaagccagcggcggtacgtgtactattactcctacctgctgaagaaccacctggactacaggccagtggccctgctgtttcacaagatgatgttcgagacaatccctatgttctccggcggcacatgcaacccacagtttgtggtgtgccagctgaaggtgaagatctattcctctaattctggcccaacccggagagaggataagttcatgtactttgagttcccacagccactgcccgtgtgcggcgacatcaaggtggagtttttccacaagcagaacaagatgctgaagaaggataagatgtttcacttctgggtgaatacctttttcatcccaggccccgaggagacatccgagaaggtggagaatggctctctgtgcgaccaggagatcgatagcatctgttccatcgagcgggccgacaacgataaggagtacctggtgctgaccctgacaaagaatgacctggataaggccaacaaggacaaggccaatagatacttcagccccaacttcaaggtgaagctgtacttcaccaagacagtggaggagccttccaatccagaggccagctcctctaccagcgtgacacctgacgtgtccgataacgagccagaccactatcggtactccgataccacagactctgatccagagaacgagccctttgacgaggatcagcacacccagatcacaaaggtg

SEQ ID NO: 199 - DNA, 1602 bp, Artificial Sequence
  Description of Artificial Sequence: Synthetic polynucleotide
ctgccacctacacggagaaggcgccggagacacatccagggaccaggacctgtgctgaacctgccaagcgccgccgccgccccacccgtggccagagccccagaggcagcaggaggaggctccagatctgaggactatagctcctctccacacagcgccgccgccgccgcccggcccctggccgccgaggagaagcaggcccagtctctgcagcccagctcctctaggcgcagctcccactaccctgcagcagtgcagtcccaggctgccgccgagaggggagcctctgccaccgcaaagtctcgcgccatcagcatcctgcagaagaagccacgccaccagcagctgctgccctctctgtctagcttctttttcagccaccggctgcccgacatgaccgccatcatcaaggagatcgtgagcagaaataagcggcggtaccaggaggatggcttcgacctggatctgacatatatctaccccaacatcatcgccatgggatttcctgcagagcggctggagggcgtgtacagaaacaatatcgacgatgtggtgaggttcctggactccaagcacaagaaccactataagatctacaatctgtgcgccgagaggcactatgataccgccaagttcaactgtcgcgtggcccagtacccctttgaggaccacaatcctccacagctggagctgatcaagcctttctgcgaggacctggatcagtggctgtccgaggacgataatcacgtggcagcaatccactgcaaggcaggcaagggcaggacaggcgtgatgatctgtgcctatctgctgcaccgcggcaagttcctgaaggcccaggaggccctggacttttacggcgaggtgaggacccgcgataagaagggcgtgacaatcccaagccagcggcggtacgtgtactattactcctacctgctgaagaaccacctggactacaggccagtggccctgctgtttcacaagatgatgttcgagacaatccctatgttctccggcggcacatgcaacccacagtttgtggtgtgccagctgaaggtgaagatctattcctctaattctggcccaacccggagagaggataagttcatgtactttgagttcccacagccactgcccgtgtgcggcgacatcaaggtggagtttttccacaagcagaacaagatgctgaagaaggataagatgtttcacttctgggtgaatacctttttcatcccaggccccgaggagacatccgagaaggtggagaatggctctctgtgcgaccaggagatcgatagcatctgttccatcgagcgggccgacaacgataaggagtacctggtgctgaccctgacaaagaatgacctggataaggccaacaaggacaaggccaatagatacttcagccccaacttcaaggtgaagctgtacttcaccaagacagtggaggagccttccaatccagaggccagctcctctaccagcgtgacacctgacgtgtccgataacgagccagaccactatcggtactccgataccacagactctgatccagagaacgagccctttgacgaggatcagcacacccagatcacaaaggtg

SEQ ID NO: 200 - DNA, 1425 bp, Artificial Sequence
  Description of Artificial Sequence: Synthetic polynucleotide
ctggccgccgaggagaagcaggcccagtctctgcagcccagctcctctaggcgcagctcccactaccctgcagcagtgcagtcccaggctgccgccgagaggggagcctctgccaccgcaaagtctcgcgccatcagcatcctgcagaagaagccacgccaccagcagctgctgccctctctgtctagcttctttttcagccaccggctgcccgacatgaccgccatcatcaaggagatcgtgagcagaaataagcggcggtaccaggaggatggcttcgacctggatctgacatatatctaccccaacatcatcgccatgggatttcctgcagagcggctggagggcgtgtacagaaacaatatcgacgatgtggtgaggttcctggactccaagcacaagaaccactataagatctacaatctgtgcgccgagaggcactatgataccgccaagttcaactgtcgcgtggcccagtacccctttgaggaccacaatcctccacagctggagctgatcaagcctttctgcgaggacctggatcagtggctgtccgaggacgataatcacgtggcagcaatccactgcaaggcaggcaagggcaggacaggcgtgatgatctgtgcctatctgctgcaccgcggcaagttcctgaaggcccaggaggccctggacttttacggcgaggtgaggacccgcgataagaagggcgtgacaatcccaagccagcggcggtacgtgtactattactcctacctgctgaagaaccacctggactacaggccagtggccctgctgtttcacaagatgatgttcgagacaatccctatgttctccggcggcacatgcaacccacagtttgtggtgtgccagctgaaggtgaagatctattcctctaattctggcccaacccggagagaggataagttcatgtactttgagttcccacagccactgcccgtgtgcggcgacatcaaggtggagtttttccacaagcagaacaagatgctgaagaaggataagatgtttcacttctgggtgaatacctttttcatcccaggccccgaggagacatccgagaaggtggagaatggctctctgtgcgaccaggagatcgatagcatctgttccatcgagcgggccgacaacgataaggagtacctggtgctgaccctgacaaagaatgacctggataaggccaacaaggacaaggccaatagatacttcagccccaacttcaaggtgaagctgtacttcaccaagacagtggaggagccttccaatccagaggccagctcctctaccagcgtgacacctgacgtgtccgataacgagccagaccactatcggtactccgataccacagactctgatccagagaacgagccctttgacgaggatcagcacacccagatcacaaaggtg

SEQ ID NO: 201 - protein, 549 aa, Mus sp.
IARAGNAGELLSPLLLPPTRRRRRRHVQGPGPVLSLPSAAAAPPLARAPEAAGGGSRCEDYPSSPHSAASAARPLAAEEKQAQSLQPSSSRRSSHYPAAVQGQAAAERGASATAKSRAISILQKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHSQITKV

SEQ ID NO: 202 - protein, 534 aa, Mus sp.
LPPTRRRRRRHVQGPGPVLSLPSAAAAPPLARAPEAAGGGSRCEDYPSSPHSAASAARPLAAEEKQAQSLQPSSSRRSSHYPAAVQGQAAAERGASATAKSRAISILQKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHSQITKV

SEQ ID NO: 203 - protein, 475 aa, Mus sp.
LAAEEKQAQSLQPSSSRRSSHYPAAVQGQAAAERGASATAKSRAISILQKKPRHQQLLPSLSSFFFSHRLPDMTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKVEFFHKQNKMLKKDKMFHFWVNTFFIPGPEETSEKVENGSLCDQEIDSICSIERADNDKEYLVLTLTKNDLDKANKDKANRYFSPNFKVKLYFTKTVEEPSNPEASSSTSVTPDVSDNEPDHYRYSDTTDSDPENEPFDEDQHSQITKV

SEQ ID NO: 204 - DNA, 1647 bp, Artificial Sequence
  Description of Artificial Sequence: Synthetic polynucleotide
atcgctagggctggaaacgctggagagctgctgtcccctctgctgctgccccctacaaggagacggcgcaggagacacgtgcagggacctggaccagtgctgtccctgccatctgccgctgctgctccaccactggctagggctcctgaggccgctggcggaggctctcgctgcgaggactacccaagctccccacacagcgccgcttccgccgctcggccactggctgctgaggagaagcaggctcagagcctgcagccttctagctcccggcgctctagccactacccagctgctgtgcagggacaggctgctgctgagaggggagcttccgccaccgctaagtccagagccatctctatcctgcagaagaagccaaggcaccagcagctgctgccttccctgtcctctttctttttctctcacaggctgcctgatatgaccgccatcatcaaggagatcgtgagcagaaacaagaggagataccaggaggacggcttcgacctggatctgacatacatctaccctaacatcatcgctatgggatttccagctgagcggctggagggcgtgtacaggaacaacatcgacgatgtggtgcggttcctggactccaagcacaagaaccactacaagatctacaacctgtgcgctgagaggcactacgacaccgccaagttcaactgtagagtggctcagtacccttttgaggatcacaaccctccacagctggagctgatcaagccattctgcgaggacctggatcagtggctgagcgaggacgataaccacgtggctgccatccactgcaaggccggaaagggccggacaggagtgatgatctgtgcttacctgctgcaccgcggcaagttcctgaaggctcaggaggccctggacttttacggagaggtgaggaccagagataagaagggcgtgacaatcccttcccagcggcgctacgtgtactactactcttacctgctgaagaaccacctggactaccgcccagtggccctgctgtttcacaagatgatgttcgagacaatcccaatgttctctggaggcacatgcaacccccagtttgtggtgtgccagctgaaggtgaagatctacagctccaacagcggaccaaccaggagagaggacaagttcatgtactttgagttcccacagcctctgcccgtgtgcggcgatatcaaggtggagtttttccacaagcagaacaagatgctgaagaaggacaagatgtttcacttctgggtcaacacctttttcatccccggacctgaggagacaagcgagaaggtggagaacggctccctgtgcgaccaggagatcgattctatctgtagcatcgagcgggccgacaacgataaggagtacctggtgctgaccctgacaaagaacgacctggataaggctaacaaggataaggccaaccgctacttttcccccaacttcaaggtgaagctgtacttcaccaagacagtggaggagccttctaacccagaggcctctagctccacctctgtgacaccagacgtgagcgataacgagcccgaccactacaggtacagcgataccacagactccgatcccgagaacgagccttttgacgaggatcagcacagccagatcaccaaggtg

SEQ ID NO: 205 - DNA, 1602 bp, Artificial Sequence
  Description of Artificial Sequence: Synthetic polynucleotide
ctgccccctacaaggagacggcgcaggagacacgtgcagggacctggaccagtgctgtccctgccatctgccgctgctgctccaccactggctagggctcctgaggccgctggcggaggctctcgctgcgaggactacccaagctccccacacagcgccgcttccgccgctcggccactggctgctgaggagaagcaggctcagagcctgcagccttctagctcccggcgctctagccactacccagctgctgtgcagggacaggctgctgctgagaggggagcttccgccaccgctaagtccagagccatctctatcctgcagaagaagccaaggcaccagcagctgctgccttccctgtcctctttctttttctctcacaggctgcctgatatgaccgccatcatcaaggagatcgtgagcagaaacaagaggagataccaggaggacggcttcgacctggatctgacatacatctaccctaacatcatcgctatgggatttccagctgagcggctggagggcgtgtacaggaacaacatcgacgatgtggtgcggttcctggactccaagcacaagaaccactacaagatctacaacctgtgcgctgagaggcactacgacaccgccaagttcaactgtagagtggctcagtacccttttgaggatcacaaccctccacagctggagctgatcaagccattctgcgaggacctggatcagtggctgagcgaggacgataaccacgtggctgccatccactgcaaggccggaaagggccggacaggagtgatgatctgtgcttacctgctgcaccgcggcaagttcctgaaggctcaggaggccctggacttttacggagaggtgaggaccagagataagaagggcgtgacaatcccttcccagcggcgctacgtgtactactactcttacctgctgaagaaccacctggactaccgcccagtggccctgctgtttcacaagatgatgttcgagacaatcccaatgttctctggaggcacatgcaacccccagtttgtggtgtgccagctgaaggtgaagatctacagctccaacagcggaccaaccaggagagaggacaagttcatgtactttgagttcccacagcctctgcccgtgtgcggcgatatcaaggtggagtttttccacaagcagaacaagatgctgaagaaggacaagatgtttcacttctgggtcaacacctttttcatccccggacctgaggagacaagcgagaaggtggagaacggctccctgtgcgaccaggagatcgattctatctgtagcatcgagcgggccgacaacgataaggagtacctggtgctgaccctgacaaagaacgacctggataaggctaacaaggataaggccaaccgctacttttcccccaacttcaaggtgaagctgtacttcaccaagacagtggaggagccttctaacccagaggcctctagctccacctctgtgacaccagacgtgagcgataacgagcccgaccactacaggtacagcgataccacagactccgatcccgagaacgagccttttgacgaggatcagcacagccagatcaccaaggtg

SEQ ID NO: 206 - DNA, 1425 bp, Artificial Sequence
  Description of Artificial Sequence: Synthetic polynucleotide
ctggctgctgaggagaagcaggctcagagcctgcagccttctagctcccggcgctctagccactacccagctgctgtgcagggacaggctgctgctgagaggggagcttccgccaccgctaagtccagagccatctctatcctgcagaagaagccaaggcaccagcagctgctgccttccctgtcctctttctttttctctcacaggctgcctgatatgaccgccatcatcaaggagatcgtgagcagaaacaagaggagataccaggaggacggcttcgacctggatctgacatacatctaccctaacatcatcgctatgggatttccagctgagcggctggagggcgtgtacaggaacaacatcgacgatgtggtgcggttcctggactccaagcacaagaaccactacaagatctacaacctgtgcgctgagaggcactacgacaccgccaagttcaactgtagagtggctcagtacccttttgaggatcacaaccctccacagctggagctgatcaagccattctgcgaggacctggatcagtggctgagcgaggacgataaccacgtggctgccatccactgcaaggccggaaagggccggacaggagtgatgatctgtgcttacctgctgcaccgcggcaagttcctgaaggctcaggaggccctggacttttacggagaggtgaggaccagagataagaagggcgtgacaatcccttcccagcggcgctacgtgtactactactcttacctgctgaagaaccacctggactaccgcccagtggccctgctgtttcacaagatgatgttcgagacaatcccaatgttctctggaggcacatgcaacccccagtttgtggtgtgccagctgaaggtgaagatctacagctccaacagcggaccaaccaggagagaggacaagttcatgtactttgagttcccacagcctctgcccgtgtgcggcgatatcaaggtggagtttttccacaagcagaacaagatgctgaagaaggacaagatgtttcacttctgggtcaacacctttttcatccccggacctgaggagacaagcgagaaggtggagaacggctccctgtgcgaccaggagatcgattctatctgtagcatcgagcgggccgacaacgataaggagtacctggtgctgaccctgacaaagaacgacctggataaggctaacaaggataaggccaaccgctacttttcccccaacttcaaggtgaagctgtacttcaccaagacagtggaggagccttctaacccagaggcctctagctccacctctgtgacaccagacgtgagcgataacgagcccgaccactacaggtacagcgataccacagactccgatcccgagaacgagccttttgacgaggatcagcacagccagatcaccaaggtg

SEQ ID NO: 207 - DNA, 49 bp, Artificial Sequence
  Description of Artificial Sequence: Synthetic primer
gtcgtatccagtgcagggtccgaggtattcgcactggatacgactcaac

SEQ ID NO: 208 - DNA, 22 bp, Artificial Sequence
  Description of Artificial Sequence: Synthetic primer
gcggcggtagcttatcagactg

SEQ ID NO: 209 - DNA, 20 bp, Artificial Sequence
  Description of Artificial Sequence: Synthetic primer
atccagtgcagggtccgagg

SEQ ID NO: 210 - DNA, 33477 bp, Artificial Sequence
  Description of Artificial Sequence: Synthetic polynucleotide
gcttccatcaaacgagttggtgctcatggcggcggcggctgctgcaaaacagatacaaaactacataagacccccaccttatatattctttcccacccttaagctagtttcgaaatcgattctagtttcgaagctgtcgaagaattcgtagctagacaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccaatgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagacgtaggatccatgcatgttaattaacatcatcaataatataccttattttggattgaagccaatatgataatgagggggtggagtttgtgacgtggcgcggggcgtgggaacggggcgggtgacgtaggttttagggcggagtaacttgtatgtgttgggaattgtagttttcttaaaatgggaagtgacgtaacgtgggaaaacggaagtgacgatttgaggaagttgtgggttttttggctttcgtttctgggcgtaggttcgcgtgcggttttctgggtgttttttgtggactttaaccgttacgtcattttttagtcctatatatactcgctctgcacttggcccttttttacactgtgactgattgagctggtgccgtgtcgagtggtgtttttttaataggttttcttttttactggtaaggctgactgttatggctgccgctgtggaagcgctgtatgttgttctggagcgggagggtgctattttgcctaggcaggagggtttttcaggtgtttatgtgtttttctctcctattaattttgttatacctcctatgggggctgtaatgttgtctctacgcctgcgggtatgtattcccccgggctatttcggtcgctttttagcactgaccgatgtgaatcaacctgatgtgtttaccgagtcttacattatgactccggacatgaccgaggagctgtcggtggtgctttttaatcacggtgaccagtttttttacggtcacgccggcatggccgtagtccgtcttatgcttataagggttgtttttcctgttgtaagacaggcttctaatgtttaaatgtttttttgttattttattttgtgtttatgcagaaacccgcagacatgtttgagagaaaaatggtgtctttttctgtggtggttccggagcttacctgcctttatctgcatgagcatgactacgatgtgctttcttttttgcgcgaggctttgcctgattttttgagcagcaccttgcattttatatcgccgcccatgcaacaagcttacatcggggctacgctggttagcatagctccgagtatgcgtgtcataatcagtgtgggttcttttgtcatggttcctggcggggaagtggccgcgctggtccgtgcagacctgcacgattatgttcagctggccctgcgaagggacctacgggatcgcggtatttttgttaatgttccgcttttgaatcttatacaggtctgtgaggaacctgaatttttgcaatcatgattcgctgcttgaggctgaaggtggagggcgctctggagcagatttttacaatggccggacttaatattcgggatttgcttagagatatattgagaaggtggcgagatgagaattatttgggcatggttgaaggtgctggaatgtttatagaggagattcaccctgaagggtttagcctttacgtccacttggacgtgagggccgtttgccttttggaagccattgtgcaacatcttacaaatgccattatctgttctttggctgtagagtttgaccacgccaccggaggggagcgcgttcacttaatagatcttcattttgaggttttggataatcttttggaataaaaaaaaaaacatggttcttccagctcttcccgctcctcccgtgtgtgactcgcagaacgaatgtgtaggttggctgggtgtggcttattctgcggtggtggatgttatcagggcagcggcgcatgaaggagtttacatagaacccgaagccagggggcgcctggatgctttgagagagtggatatactacaactactacacagagcgatctaagcggcgagaccggagacgcagatctgtttgtcacgcccgcacctggttttgcttcaggaaatatgactacgtccggcgttccatttggcatgacactacgaccaacacgatctcggttgtctcggcgcactccgtacagtagggatcgtctacctccttttgagacagaaacccgcgctaccatactggaggatcatccgctgctgcccgaatgtaacactttgacaatgcacaacgtgagttacgtgcgaggtcttccctgcagtgtgggatttacgctgattcaggaatgggttgttccctgggatatggttctaacgcgggaggagcttgtaatcctgaggaagtgtatgcacgtgtgcctgtgttgtgccaacattgatatcatgacgagcatgatgatccatggttacgagtcctgggctctccactgtcattgttccagtcccggttccctgcagtgtatagccggcgggcaggttttggccagctggtttaggatggtggtggatggcgccatgtttaatcagaggtttatatggtaccgggaggtggtgaattacaacatgccaaaagaggtaatgtttatgtccagcgtgtttatgaggggtcgccacttaatctacctgcgcttgtggtatgatggccacgtgggttctgtggtccccgccatgagctttggatacagcgccttgcactgtgggattttgaacaatattgtggtgctgtgctgcagttactgtgctgatttaagtgagatcagggtgcgctgctgtgcccggaggacaaggcgccttatgctgcgggcggtgcgaatcatcgctgaggagaccactgccatgttgtattcctgcaggacggagcggcggcggcagcagtttattcgcgcgctgctgcagcaccaccgccctatcctgatgcacgattatgactctacccccatgtaggcgtggacttctccttcgccgcccgttaagcaaccgcaagttggacagcagcctgtggctcagcagctggacagcgacatgaacttaagtgagctgcccggggagtttattaatatcactgatgagcgtttggctcgacaggaaaccgtgtggaatataacacctaagaatatgtctgttacccatgatatgatgctttttaaggccagccggggagaaaggactgtgtactctgtgtgttgggagggaggtggcaggttgaatactagggttctgtgagtttgattaaggtacggtgatctgtataagctatgtggtggtggggctatactactgaatgaaaaatgacttgaaattttctgcaattgaaaaataaacacgttgaaacataacacaaacgattctttattcttgggcaatgtatgaaaaagtgtaagaggatgtggcaaatatttcattaatgtagttgtggccagaccagtcccatgaaaatgacatagagtatgcacttggagttgtgtctcctgtttcctgtgtaccgtttagtgtaatggttagtgttacaggtttagttttgtctccgtttaagtaaacttgactgacaatgttacttttggcagttttaccgtgagattttggataagctgataggttaggcataaatccaacagcgtttgtataggctgtgccttcagtaagatctccatttctaaagttccaatattctgggtccaggaaggaattgtttagtagcactccattttcgtcaaatcttataataagatgagcactttgaactgttccagatattggagccaaactgcctttaacagccaaaactgaaactgtagcaagtatttgactgccacattttgttaagaccaaagtgagtttagcatctttctctgcatttagtctacagttaggagatggagctggtgtggtccacaaagttagcttatcattatttttgtttcctactgtaatggcacctgtgctgtcaaaactaaggccagttcctagtttaggaaccatagccttgtttgaatcaaattctaggccatggccaatttttgttttgaggggatttgtgtttggtgcattaggtgaaccaaattcaagcccatctcctgcattaatggctatggctgtagcgtcaaacatcaaccccttggcagtgcttaggttaacctcaagctttttggaattgtttgaagctgtaaacaagtaaaggcctttgttgtagttaatatccaagttgtgggctgagtttataaaaagagggccctgtcctagtcttagatttagttggttttgagcatcaaacggataactaacatcaagtataaggcgtctgttttgagaatcaatccttagtcctcctgctacattaagttgcatattgccttgtgaatcaaaacccaaggctccagtaactttagtttgcaaggaagtattattaatagtcacacctggaccagttgctacggtcaaagtgtttaggtcgtctgttacatgcaaaggagccccgtactttagtcctagttttccattttgtgtataaatgggctctttcaagtcaatgcccaagctaccagtggcagtagttagagggggtgaggcagtgatagtaagggtactgctatcggtggtggtgagggggcctgatgtttgcagggctagctttccttctgacactgtgaggggtccttgggtggcaatgctaagtttggagtcgtgcacggttagcggggcctgtgattgcatggtgagtgtgttgcccgcgaccattagaggtgcggcggcagccacagttagggcttctgaggtaactgtgaggggtgcagatatttccaggtttatgtttgacttggtttttttgagaggtgggctcacagtggttacattttgggaggtaaggttgccggcctcgtccagagagaggccgttgcccattttgagcgcaagcatgccattggaggtaactagaggttcggataggcgcaaagagagtaccccagggggactctcttgaaacccattgggggatacaaagggaggagtaagaaaaggcacagttggaggaccggtttccgtgtcatatggatacacggggttgaaggtatcttcagacggtcttgcgcgcttcatctgcaacaacatgaagatagtgggtgcggatggacaggaacaggaggaaactgacattccatttagattgtggagaaagtttgcagccaggaggaagctgcaataccagagctgggaggagggcaaggaggtgctgctgaataaactggacagaaatttgctaactgattttaagtaagtgatgctttattatttttttttattagttaaagggaataagatccccgggtactctagttaatcgacttaggcgacctgacattaactagaggatcttgatgtaatccagggttaggacagttgcaaatcacagtgagaacacagggtcccctgtcccgctcaactagcagggggcgctgggtaaactcccgaatcaggctacgggcaagctctccctgggcggtaagccggacgccgtgcgccgggccctcgatatgatcctcgggcaattcaaagtagcaaaactcaccggagtcgcgggcaaagcacttgtggcggcgacagtggaccaggtgtttcaggcgcagttgctctgcctctccacttaacattcagtcgtagccgtccgccgagtcctttaccgcgtcaaagttaggaataaattgatccggatagtggccgggaggtcccgagaaggggttaaagtagaccgatggcacaaactcctcaataaattgcagagttccaatgcctccagagcgcggctcagaggacgaggtctgcagagttaggattgcctgacgaggcgtgaatgaagagcggccggcgccgccgatctgaaatgtcccgtccggacggagaccaagcgaggagctcaccgactcgtcgttgagctgaatacctcgccctctgattgtcaggtgagttataccctgcccgggcgaccgcaccctgtgacgaaagccgcccgcaagctgcgcccctgagttagtcatctgaacttcggcctgggcgtctctgggaagtaccacagtggtgggagcgggactttcctggtacaccagggcagcgggccaactacggggattaaggttattacgaggtgtggtggtaatagccgcctgttccaggagaattcggtttcggtgggcgcgtattccgttgacccgggatatcatgtggggtcccgcgctcatgtagtttattcgggttgagtagtcttgggcagctccagccgcaagtcccatttgtggctggtaactccacatgtagggcgtgggaatttccttgctcataatggcgctgacaacaggtgctggcgccgggtgtggccgctggagatgacgtagttttcgcgcttaaatttgagaaagggcgcgaaactagtccttaagagtcagcgcgcagtatttactgaagagagcctccgcgtcttccagcgtgcgccgaagctgatcttcgcttttgtgatacaggcagctgcgggtgagggatcgcagagacctgttttttattttcagctcttgttcttggcccctgctctgttgaaatatagcatacagagtgggaaaaatcctgtttctaagctcgcgggtcgatacgggttcgttgggcgccagacgcagcgctcctcctcctgctgctgccgccgctgtggatttcttgggctttgtcagagtcttgctatccggtcgcctttgcttctgtgtggccgctgctgttgctgccgctgccgccggtgcagtatgggctgtagagatgacggtagtaatgcaggatgttacgggggaaggccacgccgtgatggtagagaagaaagcggcgggcgaaggagatgttgcccccacagtcttgcaagcaagcaactatggcgttcttgtgcccgcgccatgagcggtagccttggcgctgttgttgctcttgggctaacggcggcggctgcttggacttaccggccctggttccagtggtgtcccatctacggttgggtcggcgaacgggcagtgccggcggcgcctgaggagcggaggttgtagccatgctggaaccggttgccgatttctggggcgccggcgaggggaatgcgaccgagggtgacggtgtttcgtctgacacctcttcgacctcggaagcttcctcgtctaggctctcccagtcttccatcatgtcctcctcctcctcgtccaaaacctcctctgcctgactgtcccagtattcctcctcgtccgtgggtggcggcggcagctgcagcttctttttgggtgccatcctgggaagcaagggcccgcggctgctgctgatagggctgcggcggcggggggattgggttgagctcctcgccggactgggggtccaagtaaaccccccgtccctttcgtagcagaaactcttggcgggctttgttgatggcttgcaattggccaagaatgtggccctgggtaatgacgcaggcggtaagctccgcattaggcgggcgggattggtcttcgtagaacctaatctcgtgggcgtggtagtcctcaggtacaaatttgcgaaggtaagccgacgtccacagccccggagtgagtttcaaccccggagccgcggacttttcgtcaggcgagggaccctgcagctcaaaggtaccgataatttgactttcgttaagcagctgcgaattgcaaaccagggagcggtgcggggtgcataggttgcagcgacagtgacactccagtagaccgtcaccgctcacgtcttccattatgtcagagtggtaggcaaggtagttggctagctgcagaaggtagcagtggccccaaagcggcggagggcattcgcggtacttaatgggcacaaagtcgctaggaagtgcacagcaggtggcgggcaagattcctgagcgctctaggataaagttcctaaagttctgcaacatgctttgactggtgaagtctggcagaccctgttgcagggttttaagcaggcgttcggggaaaatgatgtccgccaggtgcgcggccacggagcgctcgttgaaggccgtccataggtccttcaagttttgctttagcagtttctgcagctccttgaggttgcactcctccaagcactgctgccaaacgcccatggccgtctgccaggtgtagcatagaaataagtaaacgcagtcgcggacgtagtcgcggcgcgcctcgcccttgagcgtggaatgaagcacgttttgcccaaggcggttttcgtgcaaaattccaaggtaggagaccaggttgcagagctccacgttggagatcttgcaggcctggcgtacgtagccctgtcgaaaggtgtagtgcaatgtttcctctagcttgcgctgcatctccgggtcagcaaagaaccgctgcatgcactcaagctccacggtaacgagcactgcggccatcattagtttgcgtcgctcctccaagtcggcaggctcgcgcgtttgaagccagcgcgctagctgctcgtcgccaactgcgggtaggccctcctctgtttgttcttgcaaatttgcatccctctccaggggctgcgcacggcgcacgatcagctcactcatgactgtgctcatgaccttggggggtaggttaagtgccgggtaggcaaagtgggtgacctcgatgctgcgttttagtacggctaggcgcgcgttgtcaccctcgagttccaccaacactccagagtgactttcattttcgctgttttcctgttgcagagcgtttgccgcgcgcttctcgtcgcgtccaagaccctcaaagatttttggcacttcgttgagcgaggcgatatcaggtatgacagcgccctgccgcaaggccagctgcttgtccgctcggctgcggttggcacggcaggataggggtatcttgcagttttggaaaaagatgtgataggtggcaagcacctctggcacggcaaatacggggtagaagttgaggcgcgggttgggctcgcatgtgccgttttcttggcgtttggggggtacgcgcggtgagaataggtggcgttcgtaggcaaggctgacatccgctatggcgaggggcacatcgctgcgctcttgcaacgcgtcgcagataatggcgcactggcgctgcagatgcttcaacagcacgtcgtctcccacatctaggtagtcgccatgcctttcgtccccccgcccgacttgttcctcgtttgcctctgcgttgtcctggtcttgctttttatcctctgttggtactgagcggtcctcgtcgtcttcgcttacaaaacctgggtcctgctcgataatcacttcctcctcctcaagcgggggtgcctcgacggggaaggtggtaggcgcgttggcggcatcggtggaggcggtggtggcgaactcagagggggcggttaggctgtccttcttctcgactgactccatgatctttttctgcctataggagaaggaaatggccagtcgggaagaggagcagcgcgaaaccacccccgagcgcggacgcggtgcggcgcgacgtcccccaaccatggaggacgtgtcgtccccgtccccgtcgccgccgcctccccgggcgcccccaaaaaagcggatgaggcggcgtatcgagtccgaggacgaggaagactcatcacaagacgcgctggtgccgcgcacacccagcccgcggccatcgacctcggcggcggatttggccattgcgcccaagaagaaaaagaagcgcccttctcccaagcccgagcgcccgccatcaccagaggtaatcgtggacagcgaggaagaaagagaagatgtggcgctacaaatggtgggtttcagcaacccaccggtgctaatcaagcatggcaaaggaggtaagcgcacagtgcggcggctgaatgaagacgacccagtggcgcgtggtatgcggacgcaagaggaagaggaagagcccagcgaagcggaaagtgaaattacggtgatgaacccgctgagtgtgccgatcgtgtctgcgtgggagaagggcatggaggctgcgcgcgcgctgatggacaagtaccacgtggataacgatctaaaggcgaacttcaaactactgcctgaccaagtggaagctctggcggccgtatgcaagacctggctgaacgaggagcaccgcgggttgcagctgaccttcaccagcaacaagacctttgtgacgatgatggggcgattcctgcaggcgtacctgcagtcgtttgcagaggtgacctacaagcatcacgagcccacgggctgcgcgttgtggctgcaccgctgcgctgagatcgaaggcgagcttaagtgtctacacggaagcattatgataaataaggagcacgtgattgaaatggatgtgacgagcgaaaacgggcagcgcgcgctgaaggagcagtctagcaaggccaagatcgtgaagaaccggtggggccgaaatgtggtgcagatctccaacaccgacgcaaggtgctgcgtgcacgacgcggcctgtccggccaatcagttttccggcaagtcttgcggcatgttcttctctgaaggcgcaaaggctcaggtggcttttaagcagatcaaggcttttatgcaggcgctgtatcctaacgcccagaccgggcacggtcaccttttgatgccactacggtgcgagtgcaactcaaagcctgggcacgcgccctttttgggaaggcagctaccaaagttgactccgttcgccctgagcaacgcggaggacctggacgcggatctgatctccgacaagagcgtgctggccagcgtgcaccacccggcgctgatagtgttccagtgctgcaaccctgtgtatcgcaactcgcgcgcgcagggcggaggccccaactgcgacttcaagatatcggcgcccgacctgctaaacgcgttggtgatggtgcgcagcctgtggagtgaaaacttcaccgagctgccgcggatggttgtgcctgagtttaagtggagcactaaacaccagtatcgcaacgtgtccctgccagtggcgcatagcgatgcgcggcagaacccctttgatttttaaacggcgcagacggcaagggtgggggtaaataatcacccgagagtgtacaaataaaagcatttgcctttattgaaagtgtctctagtacattatttttacatgtttttcaagtgacaaaaagaagtggcgctcctaatctgcgcactgtggctgcggaagtagggcgagtggcgctccaggaagctgtagagctgttcctggttgcgacgcagggtgggctgtacctggggactgttgagcatggagttgggtaccccggtaataaggttcatggtggggttgtgatccatgggagtttggggccagttggcaaaggcgtggagaaacatgcagcagaatagtccacaggcggccgagttgggcccctgtacgctttgggtggacttttccagcgttatacagcggtcgggggaagaagcaatggcgctacggcgcaggagtgactcgtactcaaactggtaaacctgcttgagtcgctggtcagaaaagccaaagggctcaaagaggtagcatgtttttgagtgcgggttccaggcaaaggccatccagtgtacgcccccagtctcgcgaccggccgtattgactatggcgcaggcgagcttgtgtggagaaacaaagcctggaaagcgcttgtcataggtgcccaaaaaatatggcccacaaccaagatctttgacaatggctttcagttcctgctcactggagcccatggcggcagctgttgttgatgttgcttgcttctttatgttgtggcgttgccggccgagaagggcgtgcgcaggtacacggtttcgatgacgccgcggtgcggctggtgcacacggaccacgtcaaagacttcaaacaaaacataaagaagggtgggctcgtccatgggatccacctcaaaagtcatgtctagcgcgtgggcggagttggcgtagagaaggttttggcccaggtctgtgagtgcgcccatggacataaagttactggagaatgggatgcgccaaagggtgcgatcgcaaagaaactttttctgggtaatgctgtcaactgcggtcttgcctataagcggataggggaagttagcagggtaggcctgtccttcgcgcatggtgggggcaaggtagccaacaaatccagagttgttgtgttggtgtaggatgcccacctgttggtagtccttgtatttagtatcatccaccacctgacggctcatgggctggaagtttctaaagaaggagtacatgcggtccttgtagctctctgggatatagaagccctggtagccaatgttatagttagctagcatttgtaccaggaaccagtctttggtcatgttacactgggcaacgttgtaaccctccccgtcaactgagcgcttaatttcaaactcgttgggggtaagcaggcggtcattgccaggccagctgacagaagagtcaaaggtaatggccaccttcttaaaggtgtggttgaggtaaaaggttccatctaggtagggtatagagccagagtaggtgtaataagggtcgtagcccgagcccagtgatggggtttccttagtcttaaggcgcgtgaaggcccagccgcggaaagccgcccagttgcgggaggggatggatatgggcacgttggtagcgttggcgggtatagggtagagcatgttggcggcggagagatagtcgttaaaggactggtcgttggtgtcgtttctaagcatggcctcaagcgtggaggcggtgttgtgggccatggggaagaaggtggcgtaaaggcaaatgctatcaaacttaatgctggctccgtcaacccttaggtcatttcctagggagctctgcagaaccatgttaacatccttcctgaagttccactcgtaggtgtatgagcccggcaggagaaggaggtttttaatggcaaagaacttctgaggcacctggatgtggaagggcacatagcgaccattgcccagcaacattgagcggtagcgcaggccagcattgcggtggtggttaaatgggttgacgttgtccatatagtcaagggaccagcgtgctccaaggttaatgtagcagtccactagcccgggagccaccactcgcttgttcatgtagtcgtaggtgtttgggttatcagaaatttttacgttggaaggactgtactttagcttgtcgggcaaatacagcgctatgttggagtacaggaaatttctccacaggttggcatttagattgatttccatggcaaaattatttccaactcttatttcatttttatctgaaaattctgtagcatctttttcccatccattttcctgacctgttttaggttttaccttggtaagagtctctgtattaatcacacctcccagtggaaagcagtaatttggaagttcatcttcagttccatgattttcaataattctaacatctggatcatagctgtcaacagcctgattccacatagaaaagtacctggttctatcaccaatggaatcaagcaaaagctggtatgaaagctctgtgtttctgtcttgcaaatctacaacagcattcaactgcgatgcttggcccgccagaacacccatattacccgtgctgttgtaatacattagaccaataaaattgtccctaaaagcaatgtaattaggcctgttgggcatagattgttggcccattagttctcgtgagttaccttccttaatagtgggcatgtaagaaatatgagtgtctggggtttctatatctacatcttcactgtacaataccactttaggagtcaagttatcaccattgcctgcggctgcctcagtagttgagaaaaattgcatttccacttgactttctagctttccattttgttgctttacaagaatgccttgccctccattttcatttgtgggttttgcatatgaaccgtaacatggtttcattggggtagtcttttttaggactctcccagctgcatgattaatttctgtttcgtaccactgagattctcctatttgaggttcaggttgaaatgttttatcggcatatttaggtgtttgaccttcgacacctatttgaataccctcctttgtaatatttataccagaataaggcgcctgcccaaatacgtgagttttttgctgctcagcttgctcgtctacttcgtcttcgttgtcatcgtcctcttcttctaggtttatttcaagagcagtagcagcttcatcccattcgcaaggatttggggcacccttgggagccagggcgttgtaggcagtgccagagtagggcttaaaagtagggcccctgtccagcacgccgcggatgtcaaagtacgtggaagccatgtccagcacacggttatcacccacagctagggtgaaccgcgccttgtacgagtacgcagtatcctcacggtccacagggatgaaccgcagcgtcaaacgctgggaccggtctgtggtcacgtcgtgcgtaggcgccaccgtggggtttctaaacttgttattcaggctgaagtacgtctcggtggcgcgggcaaactgcaccagcccggggctcaggtactccgaggcgtcctggcccgagatgtgcatgtaagaccactgcggcatcatcgaaggggtagccatcttggaaagcgggcgcgcggcggctcagcagctcctctggcggcgacatggacgcatacatgacacacatacgacacgttagctatcagaagcatcgtcggcgcttcagggattgcacccccagacccacgatgctgttcagtgtgctttgccagttgccactggctacgggccgcaacgatcgcggaccgctggcggcgcggcgcagggacgcgcggctaggacgggttacaacaacggcggtcgggcctggcagcacaggtttctgctgggtgtcggcggggggaggcaggtccagcgttacgggtgtgtgctggcccagcactccggtagccatgggcgcgatgggacgggtggtgggcaggccttgctttagtgcctcctcgtacgagggaggctcgtctatttgcgtcaccagagtttcttccctgtcggggcgcggacgcttttcgccacgcccctctggagacactgtctccacggccggtggaggctcctctacgggagggcggggatcaagcttactgttaatcttattttgcactgcctggttggccaggtccaccaccccgctaatgccagaggccaggccatctaccaccttttgttggaaattttgctctttcaacttatccctcagcatctggcctgtgctgctgttccaggccttgctgccatagttcttaacggtggaaccgaaatttttaatgccgctccacagcgagccccagctgaaggcgccaccgctcatattgctggtgccgatatcttgccagtttcccatgaacgggcgcgagccgtgtcgcggggccagagacgcaaagttgatgtcttccattctacaaaatagttacaggaccaagcgagcgtgagagtccagactttttattttgatttttccacatgcaacttgtttttaatcagtgtctctgcgcctgcaaggccacggatgcaattccgggcacggcgccaatcgccgcggcgatcagtggaataaggaggggcaggataccgccgcgcatgcgacggtgcgacgcgcgccgccgccggtggtgcgcacgacgcatgccgcccgtcaggccgtggccggccatgcccctcctacggtgcattcttcctcggaatcccggcaccgggaaacggaggcggcaggtgagggccatatctgcaagaaccacaaagaccggcttttaaacgatgctggggtggtagcgcgctgttggcagcaccagggtcctgcctccttcgcgagccaccctgcgcacggaaatcggggccagcacgggctggcgacggcgacggcggcggcgggttccagtggtggttcggcgtcgggtagttgctcgtcttctggggcggtaggtgtagccacgatagccgggggtaggcgcaatggaaggatgtagggcatattcgggcagtagcgcgctggcggcgccgtacttcctcgaacggcgcgggcgccggggggctgaaacgcgaaacatccacgggtccgtttgcacctccgtagaggtcttggacgcggccgcagcgaccgcctgcaccgcggcatccgccaccgctgaggcaaccggggacgtttgtgtctccatgccctctgtggcggtggcaatactggtgctactggtagtgggtatctgaacgtccacggtctgcacgcccagtcccggcgccacctgcttgattggccgcacgcggacctcgggctccagcccaggttccacggtcattttttccaagacatcttccagtcgctggcgcttgggtaccatcagctgcacggtgggtgccaagtcaccagactcgcgctttaggccgcgcttttcttcggacggtgcaagcgcgggcagcacctgctgcagtgttacgggctttaggctaggtgttgggttgccctcgtccagcggcaacgccagcatgtccttatgccgctttccgtaggcaaactccccgaggcgctcgttggcctgctcaagcaggtcctcgtcgccgtacacctcatcatacacgcgcttgtaggtgcgggtggagcgctcaccgggcgtaaagactacggtggtgccgggtcgcaaaacacgttttacgcgtcgacctttccactgtacccgtcgcctgggcgcggtagcgtgcagcagttccacctcgtcgtcaagttcatcatcatcatctttctttttctttttgacccgctttagctttcggggcttgtaatcctgctcttccttcttcggggggccatagatctccggcgcgatgacctggagcatctcttctttgattttgcgcttggacatagcttcgttgcgcgccgccgccgctggatacatacaacagtacgagtctaagtagttttttcttgcaatctagttgcgcggggggcgggtgcgcacgggcacgcgcaggccgctaaccgagtcgcgcacccaatacacgttgcccctgcgaccctgagtcatagcactaatggccgcggctgctgcggcggccgctcgtcgcctggacctggggggcacagtgacaatacccgcggccagccttcgagcggcccgcatggccgcccgtcggccggtgcgacgtgcgcggttaagcagggccgccgccgcgcgttgggcggcagtgccgggtcggcggcggtggcgacgtgctacgcgcctccgccgtctcttcattttagcatagcgccgggctccgcgcaccacggtctgaatggccgcgtccactgtggacactggtggcggcgtgggcgtgtagttgcgcgcctcctccaccaccgcgtcgatggcgtcatcgacggtggtgcgcccagtgcggccgcgtttgtgcgcgccccagggcgcgcggtagtgcccgcgcacgcgcactgggtgttggtcggagcgcttcttggccccgccaaacatcttgcttgggaagcgcaggccccagcctgtgttattgctgggcgatataaggatggacatgcttgctcaaaaagtgcggctcgataggacgcgcggcgagactatgcccagggccttgtaaacgtaggggcaggtgcggcgtctggcgtcagtaatggtcactcgctggactcctccgatgctgttgcgcagcggtagcgtcccgtgatctgtgagagcaggaacgttttcactgacggtggtgatggtgggggctggcgggcgcgccaaaatctggttctcgggaaagcgattgaacacgtgggtcagagaggtaaactggcggatgagttgggagtagacggcctggtcgttgtagaagctcttggagtgcacgggcaacagctcggcgcccaccaccggaaagttgctgatctggcgcgtggagcggaaggtcacggggtcttgcatcatgtctggcaacgaccagtagacctgctccgagccgcaggttacgtcaggagtgcaaagcagggtccatgagcggattccggtctgagggtcgccgtagttgtatgcaaggtaccagctgcggtactgggtgaaggtgctgtcattgcttattaggttgtaactgcgtttcttgctgtcctctgtcaggggtttgatcaccggtttcttctgaggcttctcgacctcgggttgcgcagcgggggcggcagcttcggccgctgcttcggcctcagcgcgcttctcctcagcccgtgtggcaaaggtgtcgccgcgaatggcatgatcgttcatgtcctccaccggctgcattgccgcggctgccgcgttggagttctcttccgcgccgctgccactgctgttgctgccgcctgcgccacccccgccctgttcggtgtcatctttcaagctcgcctggtaggcgtccacatccaacagtgcgggaatgttaccaccctccagatcatcgtaggtgatcctaaagccctcctggaagggttgccgcttgcggatgcccaacaagttgctcaggcggctgtgggtgaagtccaccccgcatcctggcagcaaaatgatgtctggatggaaggcttcgtttgtatataccccaggcatgacaagaccagtgacggggtcaaaccccagtctgaagttgcgggtgtcaaactttaccccgatgtcgctttccagaaccccgttctgtctgcccactttcaagtagtgctccacgatcgcgttgttcataaggtctatggtcatggtctcggagtagttgccctcgggcagcgtgaactccacccactcgtatttcagctccacctgattgtccttagtaggcaagcgcgacaccatcacccgcgccttaaacttattggtaaacatgaactcgttcacatttggcatgttggtatgcaggatggttttcaggtcgccgccccagtgcgaccggtcgtcaagattgatggtctgtgtgcttgcctcccccgggctgtagtcattgttttgaatgaccgtggtcagaaagttgctgtggtcgttctggtagttcagggatgccacatccgttgacttgttgtccaccaggtacacacgggtggtgtcgaataggggtgccaactcagagtaacggatgctgtttctccccccggtaggccgcaggtaccgcggaggcacaaacggcgggtccaggggagcatcgaagggagaacccagcgccgccgccactggcgccgcgctcaccacactctcgtaggagggaggaggaccttcctcatacatcgccgcgcgccgcatactaaggggaatacaagaaaaccaacgctcggtgccatggccttggtgagttttttattttgcatcatgcttttttttttttaaaacattctccccagcctggggcgaaggtgcgcaaacgggttgccactccctcccaaatccaggacgctgctgtcgtctgccgagtcatcgtcctcccacaccagaccccgctgacggtcgtgcctttgacgacgggtgggcgggcgcgggcctggcacgtccctgtgctcctgcgcgtacgtcttccatctactcatcttgtccactaggctctctatcccgttgttgggaaatgccggaggcaggtttttttcgcgctgcggctgcagcagcgagttgtttaggtactcctcctcgcccagcaggcgcgggcgggtggtgcgagtgctggtaagagaccctatcaagcttggaaatgggctactagcatctgaccgcggggccgcagcgcctagatcggacaagctgcttggcctgcggaagctttcctttcgcagcgccgcctctgcctgctcgcgctgttgcaactctagcagggtctgcggttgcggggaaaacacgctgtcgtctatgtcgtcccagaggaatccatcgttaccctcgggcacctcgaatcccccggtgtagaaaccagggggcggtagccagtgcgggttcaagatggcattggtgaaatactcggggttcacggcggccgcgcgatgcaagtagtccattaggcggttgataaacggccggtttgaggcatacatgcccggttccatgttgcgcgcggtcatgtccagcgccacgctgggcgttaccccgtcgcgcatcaggttaaggctcacgctctgctgcacgtagcgcaaaatgcgctcctcctcgctgtttaaactgtgcaacgaggggatcttctgccgccggttggtcagcaggtagtttagggttgcctccaggctgcccgtgtcctcctgccccagcgcgcggctgacacttgtaatctcctggaaagtatgctcgtccacatgcgcctgacctatggcctcgcggtacagtgtcagcaagtgacctaggtatgtgtcccgggacacgctgccactgtccgtgaagggcgctattagcagcagcaacaggcgcgagttgggcgtcagcaagctagacacggtcgcgcggtcgcctgtgggagcccgcaccccccacagcccctgcaagtttttgaaagcctggctcaggtttacggtctgcaggccttgtctactggtctggaaaaaatagtctggcccagactggtacacctcactttgcggtgtctcagtcaccattagccgcagtgcgctcacaaagttggtgtagtcctcctgtccccgcggcacgttggcgggctgtgtactcaggaaggcgtttagtgcaaccatggagcccaggttgccctgctgctgcgcgcgctcacgctgcgccacggcctcgcgcacatcccccaccagccggtccaggttggtctgcacgttgccgctgttgtaacgagccacgcgctgaagcagcgcgtcgtagaccaggccggcctcgtcgggccggatggccctgttttcggccagcgcgtttacgatcgccagcaccttctcgtgcgtggggtttgcgcgcgccgggaccaccgcttccagaattgcggagagccggttggcctgcggctgctgccggaacgcgtcaggattgcgcgcagtcagcgacatgatgcggtccatgacctggcgccagtcgtccgtggagttaaggccggacggctggctctgcagcgccgcccgcaccgccgggtccgttgcgtcttgcatcatctgatcagaaacatcaccgcttagtactcgccgtcctctggctcgtactcatcgtcctcgtcatattcctccacgccgccgacgttgccagcgcgcgcgggtgccaccgccagcccaggtccggccccagctgcctccagggcgcgtcggcttggggcccagcgcaggtcagcgcccgcgtcaaagtaggactcggcctctctatcgccgctgcccgtgccagccagggccctttgcaggctgtgcatcagctcgcggtcgctgagctcgcgccgccggctcacgctcacggccttgtggatgcgctcgttgcgataaacgcccaggtcgtcgctcaaggtaagcaccttcagcgccatgcgcatgtagaacccctcgatctttacctccttgtctatgggaacgtaaggggtatggtatatcttgcgggcgtaaaacttgcccaggctaagcatggaatagttgatggcggccaccttgtcagccaggctcaagctgcgctcctgcaccactatgctctgcaggatgtttatcaaatcgagcagccagcggccctcgggctctactatgtttagcagcgcatccctgaatgcctcgttgtccctgctgtgctgcactataaggaacagctgcgccatgagcggcttgctatttgggttttgctccagcgcgcttacaaagtcccacagatgcatcagtcctatagccacctcctcgcgcgccacaagcgtacgcacgtggttgttaaagcttttttgaaagttaatctcctggttcaccgtctgctcgtatgcggttaccaggtcggcggccgccacgtgtgcgcgcgcgggactaatcccggttcgcgcgtcgggctcaaagtcctcctcgcgcagcaaccgctcgcgattcaggccatgccgcagctcgcgccctgcgtggaactttcgatcccgcatctcctcgggctcctctccctcgcggtcgcgaaacaggttctgccgcggcacgtacgcctcacgcgtatcacgcttcagctgcacccttgggtgccgctcaggagagggcgctcctagccgcgccaggccctcgccctcctccaagtccaggtagtgccgggcccggcgccgcgggggttcgtaatcaccatctgctgccgcgtcaaccgcggatgtcgcccctcctgacgcggtaggaggaggggagggtgccctgcatgtctgccgctgctcttgctcttgccgctgctgaggaggggggcgcatctgccgcagcaccggatgcatctgggaaaagcaaaaaaggggctcgtccctgtttccggaggaatttgcaagcggggtcttgcatgacggggaggcaaacccccgttcgccgcagtccggccggtccgagactcgaaccgggggtcccgcgactcaacccttggaaaataaccctccggctacagggagcgagccacttaatgctttcgctttccagcctaaccgcttacgctgcgcgcggccagtggccaaaaaagctagcgcagcagccgccgcgcctggaaggaagccaaaaggagcactcccccgttgtctgacgtcgcacacctgggttcgacacgcgggcggtaaccgcatggatcacggcggacggccggatacggggctcgaaccccggtcgtccgccatgatacccttgcgaatttatccaccagaccacggaagagtgcccgcttacaggctctccttttgcacgctagagcgtcaacgattgcgcgcgcctgaccggccagagcgtcccgaccatggagcactttttgccgctgcgcaacatctggaaccgcgtccgcgactttccgcgcgcctccaccaccgccgccggcatcacctggatgtccaggtacatctacggatatcatcgccttatgttggaagatctcgcccccggagccccggccaccctacgctggcccctctaccgccagccgccgccgcactttttggtgggataccagtacctggtgcggacttgcaacgactacgtatttgactcgagggcttactcgcgtctcaggtacaccgagctctcgcagccgggtcaccagaccgttaactggtccgttatggccaactgcacttacaccatcaacacgggcgcataccaccgctttgtggacatggatgacttccagtctaccctcacgcaggtgcagcaggccatattagccgagcgcgttgtcgccgacctagccctgcttcagccgatgaggggcttcggggtcacacgcatgggaggaagagggcgccacctacggccaaactccgccgccgccgcagcgatagatgcaagagatgcaggacaagaggaaggagaagaagaagtgccggtagaaaggctcatgcaagactactacaaagacctgcgccgatgtcaaaacgaagcctggggcatggccgaccgcctgcgcattcagcaggccggacccaaggacatggtgcttctgtcgaccatccgccgtctcaagaccgcctactttaattacatcatcagcagcacctccgccagaaacaaccccgaccgccgcccgctgccgcccgccacggtgctcagcctaccttgcgactgtgactggttagacgcctttctcgagaggttttccgatccggtcgatgcggactcgctcaggtccctcggcggcggagtacctacacaacaattgttgagatgcatcgttagcgccgtatccctgccgcatggcagccccccgccaacccataaccgggacatgacgggcggcgtcttccaactgcgcccccgcgagaacggccgcgccgtcaccgagaccatgcgccgtcgccgcggggagatgatcgagcgctttgtcgaccgcctcccggtgcgccgtcgtcgccgccgtgtcccccctcccccaccgccgccagaagaagaagaaggggaggcccttatggaagaggagattgaagaagaagaagaggcccctgtagcctttgagcgcgaggtgcgcgacactgtcgccgagctcatccgtcttctggaggaggagttaaccgtgtcggcgcgcaactcccagtttttcaacttcgccgtggacttctacgaggccatggagcgccttgaggccttgggggatatcaacgaatccacgttgcgacgctgggttatgtacttcttcgtggcagaacacaccgccaccaccctcaactacctctttcagcgcctgcgaaactacgccgtcttcgcccggcacgtggagctcaatctcgcgcaggtggtcatgcgcgcccgcgatgccgaagggggcgtggtctacagccgcgtctggaacgagggaggcctcaacgccttctcgcagctcatggcccgcatttccaacgacctcgccgccaccgtggagcgagccggacgcggagatctccaggaggaagagatcgagcagttcatggccgagatcgcctatcaagacaactcaggagacgtgcaggagattttgcgccaggccgccgtcaacgacaccgaaattgattctgtcgaactctctttcaggttcaagctcaccgggcccgtcgtcttcacgcagaggcgccagattcaggagatcaaccgccgcgtcgtcgcgttcgccagcaacctacgcgcgcagcaccagctcctgcccgcgcgcggcgccgacgtgcccctgccccctctcccggcgggtccggagccccccctacctccgggggctcgcccgcgtcaccgcttttagatgcatcatccaaggacacccccgcggcccaccgcccgccgcgcggtaccgtagtcgcgccgcggggatgcggcctcttgcaagccatcgacgccgccaccaaccagcccctggaaattaggtatcacctggatctagcccgcgccctgacccgtctatgcgaggtaaacctgcaggagctcccgcctgacctgacgccgcgggagctccagaccatggacagctcccatctgcgcgatgttgtcatcaagctccgaccgccgcgcgcggacatctggactttgggctcgcgcggcgtggtggtccgatccaccgtaactcccctcgagcagccagacggtcaaggacaagcagccgaagtagaagaccaccagccaaacccgccaggcgaggggctcaaattcccactctgcttccttgtgcgcggtcgtcaggtcaacctcgtgcaggatgtacagcccgtgcaccgctgccagtactgcgcacgtttttacaaaagccagcacgagtgttcggcccgtcgcagggacttctactttcaccacatcaatagccactcctccaattggtggcgggagatccagttcttcccgatcggctcgcatcctcgcaccgagcgtctctttgtcacctacgatgtagagacctatacttggatgggggcctttgggaagcagctcgtgcccttcatgctggtcatgaagttcggcggagatgagcctctagtgactgccgcgcgagacctagccgcgaaccttggatgggaccgctgggaacaagacccgcttaccttctactgcatcaccccagaaaaaatggccataggtcgccagtttaggacctttcgcgaccacctgcaaatgctaatggcccgtgacctgtggagctcattcgtcgcttccaaccctcatcttgcagactgggccctttcagagcacgggctcagctcccctgaagagctcacctacgaggaacttaaaaaattgccttccatcaagggcatcccgcgcttcttggaactttacattgtgggccacaacatcaacggctttgacgagatcgtgctcgccgcccaggtaattaacaaccgttccgaggtgccgggacccttccgcatcacacgcaactttatgcctcgcgcgggaaagatactcttcaacgatgtcaccttcgccctgccaaatccgcgttccaaaaagcgcacggactttttgctctgggagcagggcggatgcgacgacactgacttcaaataccagtacctcaaagtcatggtcagggacacctttgcgctcacccacacctcgctccggaaggccgcgcaggcatacgcgctacccgtagaaaagggatgctgcgcctaccaggccgtcaaccagttctacatgctaggctcttaccgttcggaggccgacgggtttccgatccaagagtactggaaagaccgcgaagagtttgtcctcaaccgcgagctgtggaaaaaaaagggacaggataagtatgacatcatcaaggaaaccctggactactgcgccctagacgtgcaggtcaccgccgagctggtcaacaagctgcgcgactcctacgcctccttcgtgcgtgacgcggtaggtctcacagacgccagcttcaacgtcttccagcgtccaaccatatcatccaactcacatgccatcttcaggcagatagtcttccgagcagagcagcccgcccgtagcaacctcggtcccgacctcctcgctccctcgcacgaactatacgattacgtgcgcgccagcatccgcggtggaagatgctaccctacatatcttggaatactcagagagcccctctacgtttacgacatttgcggcatgtacgcctccgcgctcacccaccccatgccatggggtcccccactcaacccatacgagcgcgcgcttgccgcccgcgcatggcagcaggcgctagacttgcaaggatgcaagatagactacttcgacgcgcgcctgctgcccggggtctttaccgtggacgcagaccccccggacgagacgcagctagaccccctaccgccattctgctcgcgcaagggcggccgcctctgctggaccaacgagcgcctacgcggagaggtagccaccagcgttgaccttgtcaccctgcacaaccgcggttggcgcgtgcacctggtgcccgacgagcgcaccaccgtctttcccgaatggcggtgcgttgcgcgcgaatacgtgcagctaaacatcgcggccaaggagcgcgccgatcgcgacaaaaaccaaaccctgcgctccatcgccaagttgctgtccaacgccctctacgggtcgtttgccaccaagcttgacaacaaaaagattgtcttttctgaccagatggatgcggccaccctcaaaggcatcaccgcgggccaggtgaatatcaaatcctcctcgtttttggaaactgacaatcttagcgcagaagtcatgcccgcttttcagagggagtactcaccccaacagctggccctcgcagacagcgatgcggaagagagtgaggacgaacgcgcccccacccccttttatagccccccttcaggaacacccggtcacgtggcctacacctacaaaccaatcaccttccttgatgccgaagagggcgacatgtgtcttcacaccctggagcgagtggaccccctagtggacaacgaccgctacccctcccacttagcctccttcgtgctggcctggacgcgagcctttgtctcagagtggtccgagtttctatacgaggaggaccgcggaacaccgctcgaggacaggcctctcaagtctgtatacggggacacggacagccttttcgtcaccgagcgtggacaccggctcatggaaaccagaggtaagaaacgcatcaaaaagcatgggggaaacctggtttttgaccccgaacggccagagctcacctggctcgtggaatgcgagaccgtctgcggggcctgcggcgcggatgcctactccccggaatcggtatttctcgcgcccaagctctacgccctcaaaagtctgcactgcccctcgtgcggcgcctcctccaagggcaagctgcgcgccaagggccacgccgcggaggggctggactatgacaccatggtcaaatgctacctggccgacgcgcagggcgaagaccggcagcgcttcagcaccagcaggaccagcctcaagcgcaccctggccagcgcgcagcccggagcgcaccccttcaccgtgacccagactacgctgacgaggaccctgcgcccgtggaaagacatgaccctggcccgtctggacgagcaccgactactgccgtacagcgaaagccgccccaacccgcgaaacgaggagatatgctggatcgagatgccgtagagcaggtgaccgagctgtgggaccgcctggaactgcttggtcaaacgctcaaaagcatgcctacggcggacggtctcaaaccgttgaaaaactttgcttccttgcaagaactgctatcgctgggcggcgagcgccttctggcggatttggtcagggaaaacatgcgagtcagggacatgcttaacgaagtggcccccctgctcagggatgacggcagctgcagctctcttaactaccagttgcagccggtaataggtgtgatttacgggcccaccggctgcggtaagtcgcagctgctcaggaacctgctttcttcccagctgatctcccctaccccggaaaccgttttcttcatcgccccgcaggtagacatgatccccccatctgaactcaaagcgtgggaaatgcaaatctgtgagggtaactacgcccctgggccggatggaaccattataccgcagtctggcaccctccgcccgcgctttgtaaaaatggcctatgacgatctcatcctggaacacaactatgacgttagtgatcccagaaatatcttcgcccaggccgccgcccgtgggcccattgccatcattatggacgaatgcatggaaaatcttggaggtcacaagggcgtctccaagttcttccacgcatttccttctaagctacatgacaaatttcccaagtgcaccggatacactgtgctggtggttctgcacaacatgaatccccggagggatatggctgggaacatagccaacctaaaaatacagtccaagatgcatctcatatccccacgtatgcacccatcccagcttaaccgctttgtaaacacttacaccaagggcctgcccctggcaatcagcttgctactgaaagacatttttaggcaccacgcccagcgctcctgctacgactggatcatctacaacaccaccccgcagcatgaagctctgcagtggtgctacctccaccccagagacgggcttatgcccatgtatctgaacatccagagtcacctttaccacgtcctggaaaaaatacacaggaccctcaacgaccgagaccgctggtcccgggcctaccgcgcgcgcaaaacccctaaataaagacagcaagacacttgcttgatccaaatccaaacagagtctggttttttatttatgttttaaaccgcattgggaggggaggaagccttcagggcagaaacctgctggcgcagatccaacagctgctgagaaacgacattaagttcccgggtcaaagaatccaattgtgccaaaagagccgtcaacttgtcatcgcgggcggatgaacgggaagctgcactgcttgcaagcgggctcaggaaagcaaagtcagtcacaatcccgcgggcggtggctgcagcggctgaagcggcggcggaggctgcagtctccaacggcgttccagacacggtctcgtaggtcaaggtagtagagtttgcgggcaggacggggcgaccatcaatgctggagcccatcacattctgacgcaccccggcccatgggggcatgcgcgttgtcaaatatgagctcacaat

SEQ ID NO: 211 - DNA, 9709 bp, Artificial Sequence
  Description of Artificial Sequence: Synthetic polynucleotide
taacatcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatactgtcgagtctaggctcaagcagtgatccttatcgattttaccacatttgtagaggttttacttgctttaaaaaacctcccacatctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgctcgaagcggccctagaggtaccacgcgtcggaggtcagatgtaaccaagattagcccacggcgcattatataccctttaagccccgccccatttaacacgccatgcaagttaaacattatctcaccctttattaaacttacatcaactcattcagcaaacaaaggcgttaaccacacacgcaatcacaggtttacaccttatggcctggggcgtttacagctcaagtccaaaggttgcccaggctcgttaagcaagtcctcgatacattccacagcctggcgacgcccaccaactctcacggcaactggtttaatggggcacagcgggaccaccgggtgtatctcaggaggtgtgttagaaggaccggagtcacagctatccgtactactattgcattctctagacacaggtgatgtcgggcgtctcaggatagcaggcgccattttaggacggcgggtaggtcttgcaggctccggttctggctcgggctcaggctcaggttcagacacaggaccttttaaaaaaatcacaatacaaaattctttaaaccacaaaactgtaaaaattaaaaaaaaaattaccacaccaaacccaccactctatcacccactgcccataattttcacttactgtagacaaacatgccacaggtcctcatatagcaaagcgaacacataatatctgggtcccccgtattcctccggtgataatgacaagacctgcaaccgtgcccggggtgctccacataatctaacacaaactcctcaccctcttcatcctcgtcgtcactgggtggaaagccagcctcgtggcaggtaagatcgatcacctccggtacaaggtttggcatagaaaccggacccaaggctctctgctccggctgctcgggctgccgggaaaggtgaggcggctccggagaaccgggcgccggcggaaaagtgagtaagtcaatcccttcctgcaccgccaacattacagagtcgggaaaaatctgcgaaaccgcctcctcgttgggatcttcgggggccgtcacgtctaaatcatgctagccatggttgtggcaagcttatcatcgtgtttttcaaaggaaaaccacgtccccgtggttcggggggcctagacgttttttaacctcgactaaacacatgtaaagcatgtgcaccgaggccccagatcagatcccatacaatggggtaccttctgggcatccttcagccccttgttgaatacgcttgaggagagccatttgactctttccacaactatccaactcacaacgtggcactggggttgtgccgcctttgcaggtgtatcttatacacgtggcttttggccgcagaggcacctgtcgccaggtggggggttccgctgcctgcaaagggtcgctacagacgttgtttgtcttcaagaagcttccagaggaactgcttccttcacgacattcaacagaccttgcattcctttggcgagaggggaaagacccctaggaatgctcgtcaagaagacagggccaggtttccgggccctcacattgccaaaagacggcaatatggtggaaaataacatatagacaaacgcacaccggccttattccaagcggcttcggccagtaacgttaggggggggggagggagagggcggaattcggagagggcggaattcggggccgcggagatcttccaaacttggacctgggagtggacacctgtggagagaaaggcaaagtggatgtcattgtcactcaagtgtatggccagatcgggccaggtgaatatcaaatcctcctcgtttttggaaactgacaatcttagcgcagaagtcatgcccgcttttgagagggagtactcaccccaacagctggatctcaagcctgccacacctcacctcgaccatccgccggctcaagaccgcctactttaattacatcatcagcagcacctccgccagaaacaaccccgaccgccacccgctgccgcccgccacggtgctcagcctaccttgcgactgtgactggttagacgcctttctcgagaggttttccgatccggtcgatgcggactggctcaggtccctcggtggcggagtaccgttcggaggccgacgggtttccgatccaagagtactggaaagaccgcgaagagtttgtcctcaaccgcgagcccaacagctggccctcgcagacagcgatgcggaagagagtgaccgcggaggctggatcggtcccggtgtcttctatggaggtcaaaacagcgtggatggcgtctccaggcgatatgaggcgcgcccggttcactaaacaccggtaacaaacagacaatctggtctgtttgtattataccggttgcttatataggcctcccaccgtacacgcctacctcgacccggcaagcttgcccatttgcgtcaacggggcggggttattacgacattttggaaagtcccgttgattttggtgccaaaacaaactcccattgacgtcaatggggtggagacttggaaatccccgtgagtcaaaccgctatccacgcccattggtgtactgccaaaaccgcatcaccatggtaatagcgatgactaatacgtagatgtactgccaagtaggaaagtcccgtaaggtcatgtactgggcataatgccaggcgggccatttaccgtcattgacgtcaatagggggcggacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgaagcttctcgaggtcgagatcgatctgggcgtggttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccgggtgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagagggagtttaaacgaattcaatagcttgttgcatgggcggcgatataaaatgcaaggtgctgctcaaaaaatcaggcaaagcctcgcgcaaaaaagaaagcacatcgtagtcatgctcatgcagataaaggcaggtaagctccggaaccaccacagaaaaagacaccatttttctctcaaacatgtctgcgggtttctgcataaacacaaaataaaataacaaaaaaacatttaaacattagaagcctgtcttacaacaggaaaaacaacccttataagcataagacggactacggccatgccggcgtgaccgtaaaaaaactggtcaccgtgattaaaaagcaccaccgacagctcctcggtcatgtccggagtcataatgtaagactcggtaaacacatcaggttgattcatcggtcagtgctaaaaagcgaccgaaatagcccgggggaatacatacccgcaggcgtagagacaacattacagcccccataggaggtataacaaaattaataggagagaaaaacacataaacacctgaaaaaccctcctgcctaggcaaaatagcaccctcccgctccagaacaacatacagcgcttcacagcggcagcctaacagtcagccttaccagtaaaaaagaaaacctattaaaaaaacaccactcgacacggcaccagctcaatcagtcacagtgtaaaaaagggccaagtgcagagcgagtatatataggactaaaaaatgacgtaacggttaaagtccacaaaaaacacccagaaaaccgcacgcgaacctacgcccagaaacgaaagccaaaaaacccacaacttcctcaaatcgtcacttccgttttcccacgttacgtaacttcccattttaagaaaactacaattcccaacacatacaagttactccgccctaaaacctacgtcacccgccccgttcccacgccccgcgccacgtcacaaactccaccccctcattatcatattggcttcaatccaaaataaggtatattattgatgatgttaattaacatgcatggatccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcagccatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattttgttaaaatttttgttaaatcagctcattttttaaccaataggccgaaatcggcaacatcccttataaatcaaaagaatagaccgcgatagggttgagtgttgttccagtttggaacaagagtccactattaaagaacgtggactccaacgtcaaagggcgaaaaaccgtctatcagggcgatggcccactacgtgaaccatcacccaaatcaagttttttgcggtcgaggtgccgtaaagctctaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgcgcgcttaatgcgccgctacagggcgcgtccattcgccattcaggatcgaattaattcttaat

SEQ ID NO: 212 - DNA, 38 bp, Artificial Sequence
  Description of Artificial Sequence: Synthetic primer
aaaagaattcgattgggttcgattggcaatgttgtctc

SEQ ID NO: 213 - DNA, 38 bp, Artificial Sequence
  Description of Artificial Sequence: Synthetic primer
aaaaactagtgatgtcccgggtacgaccatcacccgag

SEQ ID NO: 214 - DNA, 35 bp, Artificial Sequence
  Description of Artificial Sequence: Synthetic primer
aaaaaagcttcacgacatgctcccccccgacgagc

SEQ ID NO: 215 - DNA, 35 bp, Artificial Sequence
  Description of Artificial Sequence: Synthetic primer
aaaacagctgacgcggaactagcgcggaccggtcg

SEQ ID NO: 216 - DNA, 46 bp, Artificial Sequence
  Description of Artificial Sequence: Synthetic oligonucleotide
ctagtgaattctagtggatcccccgggctgcaggaattcgatatca

SEQ ID NO: 217 - DNA, 46 bp, Artificial Sequence
  Description of Artificial Sequence: Synthetic oligonucleotide
agcttgatatcgaattcctgcagcccgggggatccactagaattca

SEQ ID NO: 218 - DNA, 25 bp, Artificial Sequence
  Description of Artificial Sequence: Synthetic primer
ctctgacctgagattggcggcactg

SEQ ID NO: 219 - DNA, 46 bp, Artificial Sequence
  Description of Artificial Sequence: Synthetic primer
gcggccgcagcgctgcggccgccgcgggcgcgctcctgaccgcggg

SEQ ID NO: 220 - DNA, 47 bp, Artificial Sequence
  Description of Artificial Sequence: Synthetic primer
gcggccgcagcgctgcggccgccagcgcggcggggcccggccaacca

SEQ ID NO: 221 - DNA, 25 bp, Artificial Sequence
  Description of Artificial Sequence: Synthetic primer
ttcttccctcttctcccgccctcca

SEQ ID NO: 222 - protein, 6 aa, Artificial Sequence
  Description of Artificial Sequence: Synthetic 6xHis tag
HHHHHH

SEQ ID NO: 223 - RNA, 250 nt, Artificial Sequence
  Description of Artificial Sequence: Synthetic polynucleotide
  misc_feature (1)..(250): This sequence may encompass 100-250 nucleotides
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 224 - protein, 10 aa, Artificial Sequence
  Description of Artificial Sequence: Synthetic peptide
YPYDVPDYAC

What is claimed is:

1. A fusion protein comprising human serum albumin (HSA) and human Phosphatase and Tensin Homolog (PTEN) tumor suppressor, wherein the HSA is upstream to the PTEN tumor suppressor.

2. The fusion protein of claim 1, wherein the HSA comprises the polypeptide of SEQ ID NO: 12 and the PTEN tumor suppressor comprises the polypeptide of SEQ ID NO: 2.

3. A method of producing the fusion protein of claim 1, comprising
   (i) culturing a host cell capable of expressing the fusion protein under conditions suitable for expression of the fusion protein; and
   (ii) purifying or isolating the fusion protein optionally from the cell or cell culture medium,
   whereby achieving one or more of: a high yield, a low aggregation, or a high stability compared to a produced wildtype PTEN protein, and optionally wherein after or during the culture, supernatant of host cells comprises more than about 5 µg/ml of secreted fusion protein.

4. The method of claim 3, wherein the host cell comprises a polynucleotide encoding the fusion protein or a vector comprising the polynucleotide.

5. A composition comprising the fusion protein of claim 1 and a carrier.

6. The composition of claim 5, wherein the carrier is a pharmaceutically acceptable carrier.

7. The fusion protein of claim 1, wherein the HSA comprises a polypeptide as set forth in any one of: SEQ ID NO: 12, SEQ ID NO: 163, SEQ ID NO: 13, amino acids 1-197 of SEQ ID NO:13, amino acids 1-395 of SEQ ID NO:13, amino acids 198-585 of SEQ ID NO:13, amino acids 35-385 of SEQ ID NO:13, or amino acids 63-585 of SEQ ID NO:13.

8. The fusion protein of claim 7, wherein the HSA further comprises a mutation at a position aligned to amino acid 58 of SEQ ID NO: 12.

9. The fusion protein of claim 8, wherein the PTEN tumor suppressor comprises the polypeptide as set forth in any one of SEQ ID NO: 1, 2, 3, 6, 7, 8, 88, 89, 162, 201, 202, or 203.

10. The fusion protein of claim 9, wherein the PTEN tumor suppressor further comprises a mutation at a position aligned to any one of S65, S85, S89, S91, S94, S111, S115, S117, S129, S134, T140, S161, S163, S164 or S168 of SEQ ID NO:1 or S170, N292, S355, S360, 5366 or 5370 of SEQ ID NO:2.

11. The fusion protein of claim 7, wherein the PTEN tumor suppressor comprises the polypeptide as set forth in any one of SEQ ID NO: 1, 2, 3, 6, 7, 8, 88, 89, 162, 201, 202, or 203.

12. The fusion protein of claim 11, wherein the PTEN tumor suppressor further comprises a mutation at a position aligned to any one of S65, S85, S89, S91, S94, 5111, 5115, S117, S129, S134, T140, S161, S163, S164 or S168 of SEQ ID NO:1 or S170, N292, S355, S360, 5366 or 5370 of SEQ ID NO:2.

13. The fusion protein of claim 1, wherein the PTEN tumor suppressor comprises the polypeptide as set forth in any one of SEQ ID NO: 1, 2, 3, 6, 7, 8, 88, 89, 162, 201, 202, or 203.

14. The fusion protein of claim 13, wherein the PTEN tumor suppressor further comprises a mutation at a position aligned to any one of S65, S85, S89, S91, S94, 5111, 5115, S117, S129, S134, T140, S161, S163, S164 or S168 of SEQ ID NO:1 or S170, N292, S355, S360, S366 or 5370 of SEQ ID NO:2.

15. The fusion protein of claim 1, wherein the HSA comprises a polypeptide as set forth in SEQ ID NO: 12 and the PTEN tumor suppressor comprises a polypeptide as set forth in SEQ ID NO: 2.

16. A polynucleotide encoding a fusion protein comprising human serum albumin (HSA) and human Phosphatase and Tensin Homolog (PTEN) tumor suppressor, wherein the HSA is upstream to the PTEN tumor suppressor.

17. The polynucleotide of claim 16, wherein the polynucleotide comprises SEQ ID NOs: 180, 176 and 172, or a polynucleotide at least 90% identical thereto and which encodes the same amino acid sequence as SEQ ID NOs: 180, 176 and 172, respectively.

18. The polynucleotide of claim 16, further comprising a regulatory sequence for expression or replication of the polynucleotide in a host cell, optionally wherein the regulatory sequence comprises a promoter and optionally an enhancer.

19. The polynucleotide of claim 16, consisting of polynucleotides as set forth in SEQ ID NOs: 180, 176 and 172.

20. A vector comprising the polynucleotide of claim 16.

21. The vector of claim 20, wherein the vector is a viral vector, optionally selected from the group of: rabies virus, flavivirus, lentivirus, baculovirus, retroviral vectors, adenovirus vectors, adeno-associated virus vectors, herpes simplex virus vectors, alphavirus vectors, Seneca Valley virus, poliovirus, vaccinia virus, reovirus, Coxsackievirus, parvovirus, Newcastle disease virus, vesicular stomatitis virus, measles virus, or infectious tobacco mosaic virus (TMV).

22. The vector of claim 20, wherein the vector is a non-viral vector, optionally selected from liposomes, cationic lipid, micelles biocompatible polymers, nanoparticles, lipoproteins, polypeptides, polysaccharides, lipopolysaccharides, metal particles, bacteria, bacteriophage, cosmid, plasmid, a yeast artificial chromosome, or fungal vectors.

23. A composition comprising the vector of claim 20 and a carrier.

24. The composition of claim 23, wherein the carrier is a pharmaceutically acceptable carrier.

25. A composition comprising the polynucleotide of claim 16 and a carrier.

26. The composition of claim 25, wherein the carrier is a pharmaceutically acceptable carrier.

27. A host cell comprising a polynucleotide that encodes a fusion protein comprising human serum albumin (HSA) and human Phosphatase and Tensin Homolog (PTEN) tumor suppressor, wherein the HSA is upstream to the PTEN tumor suppressor.

28. A method for producing the host cell of claim 27, comprising inserting a vector comprising the polynucleotide encoding the fusion protein into the host cell.

29. The method of claim 28, further comprising generating the vector prior to inserting it into the host cell.

* * * * *